US010696726B2

(12) United States Patent
DiMarchi et al.

(10) Patent No.: US 10,696,726 B2
(45) Date of Patent: Jun. 30, 2020

(54) INSULIN-INCRETIN CONJUGATES

(71) Applicant: INDIANA UNIVERSITY RESEARCH AND TECHNOLOGY CORPORATION, Indianapolis, IN (US)

(72) Inventors: Richard D. DiMarchi, Carmel, IN (US); Todd Parody, Bloomington, IN (US); Jie Han, Beijing (CN); Pengyun Li, Bloomington, IN (US)

(73) Assignee: Indiana University Research and Technology Corporation, Indianapolis, IN (US)

( * ) Notice: Subject to any disclaimer, the term of this patent is extended or adjusted under 35 U.S.C. 154(b) by 122 days.

(21) Appl. No.: 15/846,485

(22) Filed: Dec. 19, 2017

(65) Prior Publication Data

US 2018/0194827 A1 Jul. 12, 2018

Related U.S. Application Data

(63) Continuation of application No. 14/774,357, filed as application No. PCT/US2014/020801 on Mar. 5, 2014, now abandoned.

(60) Provisional application No. 61/783,491, filed on Mar. 14, 2013.

(51) Int. Cl.
*A61K 38/28* (2006.01)
*C07K 14/62* (2006.01)
*C07K 14/605* (2006.01)

(52) U.S. Cl.
CPC ............ *C07K 14/62* (2013.01); *C07K 14/605* (2013.01); *C07K 2319/00* (2013.01)

(58) Field of Classification Search
CPC .............................. C07K 14/62; C07K 14/605
See application file for complete search history.

(56) References Cited

U.S. PATENT DOCUMENTS

| | | | |
|---|---|---|---|
| 3,740,385 A | 6/1973 | Ondetti | |
| 4,275,152 A | 6/1981 | Esders et al. | |
| 4,741,897 A | 5/1988 | Andrews et al. | |
| 4,876,242 A | 10/1989 | Applebaum et al. | |
| 4,985,407 A | 1/1991 | Foxton et al. | |
| 5,028,586 A | 7/1991 | Balschmidt et al. | |
| 5,359,030 A | 10/1994 | Ekwuribe | |
| 5,510,459 A | 4/1996 | Smith et al. | |
| 5,512,549 A | 4/1996 | Chen et al. | |
| 5,514,646 A | 5/1996 | Chance et al. | |
| 5,545,618 A | 8/1996 | Buckley et al. | |
| 5,665,705 A | 9/1997 | Merrifield et al. | |
| 5,759,818 A | 6/1998 | Boime | |
| 5,783,674 A | 7/1998 | Geysin et al. | |
| 5,843,634 A | 12/1998 | Brate et al. | |
| 6,180,767 B1 | 1/2001 | Wickstrom et al. | |
| 6,191,102 B1 | 2/2001 | DiMarchi et al. | |
| 6,197,926 B1 | 3/2001 | Gaur et al. | |
| 6,329,336 B1 | 12/2001 | Bridon et al. | |
| 6,476,290 B1 | 11/2002 | Wright et al. | |
| 6,583,111 B1 | 6/2003 | DiMarchi et al. | |
| 6,630,348 B1 | 10/2003 | Lee et al. | |
| 6,677,136 B2 | 1/2004 | Marshall et al. | |
| 6,746,853 B1 | 6/2004 | Dahiyat et al. | |
| 7,045,337 B2 | 5/2006 | Schultz et al. | |
| 7,192,922 B2 | 3/2007 | Shannon et al. | |
| 7,211,557 B2 | 5/2007 | DiMarchi et al. | |
| 7,326,688 B2 | 2/2008 | O'Harte et al. | |
| 7,521,422 B2 | 4/2009 | Bernard | |
| 7,557,183 B2 | 7/2009 | DiMarchi et al. | |
| 7,576,059 B2 | 8/2009 | Jonassen et al. | |
| 8,053,560 B2 | 11/2011 | Sheffer et al. | |
| 9,573,987 B2 | 2/2017 | DiMarchi et al. | |
| 2002/0038026 A1 | 3/2002 | Rao et al. | |
| 2002/0049164 A1 | 4/2002 | Demuth et al. | |
| 2002/0160938 A1 | 10/2002 | Brandenburg et al. | |
| 2003/0021795 A1 | 1/2003 | Houston et al. | |
| 2003/0143183 A1 | 7/2003 | Knudsen et al. | |
| 2003/0195147 A1 | 10/2003 | Pillutla et al. | |
| 2003/0195157 A1 | 10/2003 | Natarajan et al. | |
| 2003/0204063 A1 | 10/2003 | Gravel et al. | |
| 2004/0002468 A1 | 1/2004 | Wadsworth et al. | |
| 2004/0054130 A1 | 3/2004 | Ng et al. | |
| 2004/0121940 A1 | 6/2004 | DeGroot et al. | |
| 2004/0235710 A1 | 11/2004 | DeFelippis et al. | |
| 2005/0014679 A1 | 1/2005 | Beals et al. | |
| 2005/0070469 A1 | 3/2005 | Bloom et al. | |
| 2005/0095679 A1 | 5/2005 | Prescott et al. | |
| 2005/0124550 A1 | 6/2005 | Peri | |
| 2005/0153890 A1 | 7/2005 | Pan et al. | |
| 2005/0187147 A1 | 8/2005 | Newman et al. | |
| 2005/0288248 A1 | 12/2005 | Pan et al. | |

(Continued)

FOREIGN PATENT DOCUMENTS

| EP | 0220958 | 5/1987 |
|---|---|---|
| EP | 741188 | 11/1996 |

(Continued)

OTHER PUBLICATIONS

J. Vora, "Combining Incretin-Based Therapies With Insulin: Realizing the potential in type 2 diabetes", Diabetes Care, vol. 36, No. Supplement 2, Jul. 23, 2013.

Jain et al., "Mutual prodrugs containing bio-cleavable and drug releasable disulfide linkers", Bioorganic Chemistry, vol. 49, Aug. 1, 2013.

Finan et al., "Unimolecular Dual Incretins Maximize Metabolic Benefits in Rodents, Monkeys, and Humans", Science Translational Medicine, vol. 5, No. 209, Oct. 30, 2013.

Kaur et al., "Discovery of High Potency, Single-Chain Insulin Analogs with a Shortened B-Chain and Nonpeptide Linker", ACS Chemical Biology, vol. 8, No. 8, Aug. 16, 2013.

(Continued)

*Primary Examiner* — Gyan Chandra

(74) *Attorney, Agent, or Firm* — Barnes & Thornburg LLP

(57) ABSTRACT

Disclosed herein are insulin agonist peptides conjugated to a glucagon analog wherein the insulin/glucagon conjugate is targeted to liver tissues upon administration to a patient.

14 Claims, 20 Drawing Sheets

Specification includes a Sequence Listing.

(56) References Cited

U.S. PATENT DOCUMENTS

| | | |
|---|---|---|
| 2006/0003417 A1 | 1/2006 | Pan et al. |
| 2006/0003935 A1 | 1/2006 | Pan et al. |
| 2006/0084604 A1 | 4/2006 | Kitaura et al. |
| 2006/0171920 A1 | 8/2006 | Shechter et al. |
| 2006/0210534 A1 | 9/2006 | Lee et al. |
| 2006/0223753 A1 | 10/2006 | Glass |
| 2006/0252916 A1 | 11/2006 | DiMarchi et al. |
| 2006/0286129 A1 | 12/2006 | Sarubbi |
| 2007/0042956 A1 | 2/2007 | Johansen et al. |
| 2007/0129284 A1 | 6/2007 | Kjeldsen et al. |
| 2007/0173452 A1 | 7/2007 | DiMarchi et al. |
| 2007/0203058 A1 | 8/2007 | Lau et al. |
| 2007/0224119 A1 | 9/2007 | McTavish |
| 2007/0287670 A1 | 12/2007 | Natarajan et al. |
| 2008/0113411 A1 | 5/2008 | Sheffer et al. |
| 2008/0113905 A1 | 5/2008 | DiMarchi et al. |
| 2008/0125574 A1 | 5/2008 | Sheffer et al. |
| 2008/0299096 A1 | 12/2008 | Tatake et al. |
| 2008/0312157 A1 | 12/2008 | Levy et al. |
| 2008/0318837 A1 | 12/2008 | Quay et al. |
| 2009/0036364 A1 | 2/2009 | Levy et al. |
| 2009/0054305 A1 | 2/2009 | Schlein et al. |
| 2009/0062192 A1 | 3/2009 | Christensen et al. |
| 2009/0074769 A1 | 3/2009 | Glaesner et al. |
| 2009/0137456 A1 | 5/2009 | DiMarchi et al. |
| 2009/0176964 A1 | 7/2009 | Walensky et al. |
| 2009/0186817 A1 | 7/2009 | Ghosh et al. |
| 2009/0192072 A1 | 7/2009 | Pillutla et al. |
| 2009/0209453 A1 | 8/2009 | Moyle |
| 2009/0221037 A1 | 9/2009 | Lee et al. |
| 2010/0081614 A1 | 4/2010 | Fares et al. |
| 2010/0190699 A1 | 7/2010 | DiMarchi et al. |
| 2010/0190701 A1 | 7/2010 | Day et al. |
| 2010/0204105 A1 | 8/2010 | Riber et al. |
| 2011/0065633 A1 | 3/2011 | DiMarchi et al. |
| 2011/0098217 A1 | 4/2011 | DiMarchi et al. |
| 2011/0166062 A1 | 7/2011 | DiMarchi et al. |
| 2011/0190200 A1 | 8/2011 | DiMarchi et al. |
| 2011/0257091 A1 | 10/2011 | DiMarchi |
| 2011/0257092 A1 | 10/2011 | DiMarchi et al. |
| 2011/0288003 A1 | 11/2011 | DiMarchi et al. |
| 2012/0010134 A1 | 1/2012 | Zion et al. |
| 2012/0184489 A1 | 7/2012 | Rau et al. |
| 2014/0120120 A1 | 5/2014 | Woo et al. |

FOREIGN PATENT DOCUMENTS

| | | |
|---|---|---|
| EP | 1161452 | 2/2000 |
| EP | 2036539 A1 | 3/2009 |
| EP | 2036923 A1 | 3/2009 |
| WO | 1990/12814 | 11/1990 |
| WO | 1993/03174 | 2/1993 |
| WO | 1996/34882 | 11/1996 |
| WO | 1998/11126 | 3/1998 |
| WO | 1999/46283 | 9/1999 |
| WO | 2000/50456 | 8/2000 |
| WO | 2002/010195 | 2/2002 |
| WO | 2004/067548 | 8/2004 |
| WO | 2004/078777 | 9/2004 |
| WO | 2005/054291 | 6/2005 |
| WO | 2005-077072 | 8/2005 |
| WO | 2006/047214 | 5/2006 |
| WO | 2006/097521 | 9/2006 |
| WO | 2007/096332 | 8/2007 |
| WO | 2008/019368 | 2/2008 |
| WO | 2008/021560 | 2/2008 |
| WO | 2008/025528 | 3/2008 |
| WO | 2008/081418 | 7/2008 |
| WO | WO09034118 A1 | 3/2009 |
| WO | WO09034119 A1 | 3/2009 |
| WO | 2009/067636 | 5/2009 |
| WO | 2009/095479 | 8/2009 |
| WO | 2009/099763 | 8/2009 |
| WO | 2010/011313 | 1/2010 |
| WO | 2010/071807 | 6/2010 |
| WO | 2010/080605 | 7/2010 |
| WO | 2010-080606 | 7/2010 |
| WO | 2010/080607 | 7/2010 |
| WO | 2010/080609 | 7/2010 |
| WO | 2011/012718 | 2/2011 |
| WO | 2011/159895 | 12/2011 |
| WO | 2011/163012 | 12/2011 |
| WO | 2011/163460 | 12/2011 |
| WO | 2011/163462 | 12/2011 |
| WO | 2012/098462 | 7/2012 |
| WO | 2012/165915 | 12/2012 |
| WO | 2012-167744 | 12/2012 |
| WO | 2013/096386 | 6/2013 |
| WO | 2014/158900 | 10/2014 |

OTHER PUBLICATIONS

Chakradhar, "All in one: Researchers create combination drugs for diabetes and obesity", Nature Medicine, vol. 22, Jan. 1, 2016.
Extended European Search Report, European Application No. 15845481.9-1466/ 3206710, PCT/US2015051728, dated Nov. 21, 2017, 10 pages.
"Application of Chemical Biotechnology to Optimization of Endocrine Hormones," Carothers Lecture, Mar. 22, 2007.
"Biotechnology—A Basis for Better Health & Economic Prosperity," Ohio State University presentation, Aug. 28, 2010.
"Biotechnology—A Basis for Better Health & Economic Prosperity," Indiana University television presentation, Nov. 2010.
"Emergence of Chemical Biotechnology," Eli Lilly and Co. presentation, Jun. 22, 2009.
"Legacy Products—'Back to the Future'," presentation to Eli Lilly and Co., Sep. 22, 2005.
"Molecular Miracles," Indiana University, Apr. 13, 2011.
"Novel Glucagon Peptides That Demonstrate the Virtues of Combinatorial Pharmacology," University of Toledo, Mar. 22, 2012.
"Novel Glucagon-Based Peptides—Virtues of Combinatorial Pharmacology," European Peptide Symposium, Sep. 5-9, 2010, Copenhagen, Denmark.
"Novel Glucagon-Based Peptides—Virtues of Combinatorial Pharmacology," University of Michigan, Oct. 13, 2010.
"Novel Glucagon-Based Peptides—Virtues of Combinatorial Pharmacology," Yale University, May 13, 2011.
"Novel Glucagon-Based Peptides—Virtues of Combinatorial Pharmacology," Aug. 31, 2011, Berlin.
"Novel Glucagon-Like Chimera Peptides—Virtues of Combinatorial Pharmacology," Keystone Conference, Apr. 12-17, 2010, Whistler, B.C.
"Novel Glucagon-Like Chimera Peptides—Virtues of Combinatorial Pharmacology," AAPS May 2010.
"Novel Glucagon-Like Chimera Peptides—Virtues of Combinatorial Pharmacology," University of Cincinnati, Jun. 2010.
"Novel Glucagon-Like Chimera Peptides—Virtues of Combinatorial Pharmacology," AAPS 2005 San Francisco.
"Peptides: Frontiers of Peptide Science," Proceedings of the Fifteenth American Peptide Symposium, Jun. 14-19, 1997, Nashville, Tennessee, USA; ed. James P. Tam and Praven T.P. Kaumaya.
"Speaking From the Gut: From Gastrointestinal Hormones to Combinatorial Therapies," Presentation to American Diabetes Association, Jun. 25, 2011.
"The Emergence of Chemical Biotechnology & Its Application to Optimization of Endocrine Hormones," UMBC presentation, Mar. 26, 2008.
"The Pursuit of Transformational Medicines," Keystone presentation, Jan. 29-Feb. 3, 2012, Santa Fe, NM.
"The Pursuit of Transformational Medicines," NP2D presentation, Dec. 4, 2011.
"The Pursuit of Transformational Medicines," presentation to American Peptide Symposium, Jun. 25-30, 2011, San Diego, CA.
"Two for the Money" Gut Hormone Hybrids, Tschoep, ADA meeting, Jun. 25-29, 2010, Orlando, FL.
Althage et al.,JBC "Targeted Ablation of GIP-Producing Cells in Transgenic mice reduces obesity and insulin resistance induced by a high fat diet" 2008).

(56) References Cited

OTHER PUBLICATIONS

Andrews et al., "Forming Stable Helical Peptides Using Natural and Artificial Amino Acids", Tetrahedron 55: 11711-11743, (1999).

Azizeh et al., "Pure glucagon antagonists: biological activities and cAMP accumulation using phosphodiesterase inhibitors," Peptides 1997, vol. 18, No. 5, pp. 633-641.

Azizeh et al., "Topographical amino acid substitution in position 10 of glucagon leads to antagonists/partial agonists with greater binding differences," J. Med. Chem., vol. 39, No. 13, Jun. 21, 1996, pp. 2449-2455.

Azizeh et al., "The role of phenylalanine at position 6 in glucagon's mechanism of biological action: multiple replacement analogues of glucagon" J Med Chem 1997, 40, 2555-2562.

Blache et al., "Development of an oxyntomodulin/glicentin C-terminal radioimmunoassay using a "thiol-maleoyl" coupling method for preparing the immunogen," Anal Biochem 1988 173(1):151-159 (1988), abstract only.

Breiner, M., et al., Heterogeneity of Insulin-Receptors in Rat-Tissues as Detected with the Partial Agonist B29,B29'-Suberoyl-Insulin. Molecular Pharmacology, 1993. 44(2): p. 271-276.

Cheng et al., "The Development of an Insulin-based Prodrug," APS poster presentation, 2011.

Chia et al., "Exogenous glucose-dependent insulinotropic polypeptide worsens post-prandial hyperglycemia in type 2 diabetes," Diabetes, 58: 1342-1349 (2009).

Cloutier, et al, "Low-energy (3-24eV) electron damage to the peptide backbone" J Phys Chem B. 111(7), p. 1620-1624 (Feb. 22, 2007).

Coffman et al., "Insulin-metal ion interactions: the binding of divalent cations to insulin hexamers and tetramers and the assembly of insulin-hexamers," Biochemistry, Aug. 9, 1988, vol. 27, No. 16, pp. 6179-6187.

Collie et al., "Purification and sequence of rat oxyntomodulin," Proc. Natl. Acad. Sci. USA, vol. 91, pp. 9362-9366, Sep. 1994.

Coy et al, J of Medicinal Chemistry, 1973, vol. 16, No. 7, 827-829.

Day et al., "A new glucagon and GLP-1 co-agonist eliminates obesity in rodents", Nature Chemical Biology (2009), 5(10), 749-757.

Day, J.; Patterson, J.; Gelfanov, V. and DiMarchi, Richard Molecular-basis for Specificity in Biological Action at the Homologous Glucagon and GLP-1 Receptors, (2009) Proceedings of the 21$^{st}$ American Peptide Society 142-143.

De, A. and DiMarchi, R. Synthesis & Analysis of Peptide Hormone-based prodrugs, (2009) Proceedings of the 21st American Peptide Society 160-161.

De, Design of peptide-based prodrug chemistry and its application to glucagon-like peptide 1. Masters Thesis Aug. 2007. [Retrieved from the Internet on Jun. 16, 2009: <https://scholarworks iu.edu/dspace/browse?value=De%2C+ArnabB type=author>]; p. 8, para 2; p. 16, para 3; p. 40, para 1; p. 66, para 2; p. 77, para 1-2; p. 79, para 1.

De, et al., "Investigation of the feasibily of an amide-based prodrug under physiological conditions," Int. J. Pept. Res. Ther., 14, pp. 255-262 (2008).

DiMarchi, "Peptides—Development of Prodrug Chemistry," RBF Symposium Feb. 1-4, 2011 India.

DiMarchi, Richard, "The Use of Bioproducts in the Treatments of Metabolic Diseases" presentation slides for the Keystone Symposia (Jan. 25, 2009, Banff, Alberta).

Drucker, "Glucagon Gene Expression in Vertebrate Brain," The Journal of Biological Chemistry, vol. 263, No. 27, pp. 13475-13478, 1988.

Drucker, "The biology of incretin hormones," Cell Metabolism 3:153-165 (2006).

Du et al., "Biochemistry and Molecular Biology International," vol. 45, No. 2, Jun. 1, 1998, pp. 255-260 XP008147747.

Du X et al, Hydroxyl group of insulin A19Tyris essential for receptor binding: studies on (A9Phe) insulin, BioChem and Mol Biology International, Academic Press, Lindon, GB vol. 45, No. 2, Jun. 1, 1998, pp. 255-260. found in extended EP search report 09837982.9.

Eriksson et al., "hPEPT1 Affinity and Translocation of Selected Gln-Sar and Glu-Sar Dipeptide Derivatives", Molecular Pharmaceutics vol. 2, No. 3: 242-249 (May 10, 2005).

Evans et al., "Effect of β-Endorphin C-Terminal Peptides on Glucose Uptake in Isolated Skeletal Muscles of the Mouse," Peptides, vol. 18, No. 1, pp. 165-167, (1997).

Extended European Search Report, European Application No. 14773636.7-1402 / 2970511 PCT/US2014/020801, dated Feb. 22, 2016.

Finan, B.; Gelfanov, V. and DiMarchi, R. Assessment of a Tat-Derived Peptide as a Vector for Hormonal Transport, (2009) Proceedings of the 21st American Peptide Society 321-322.

G. Rajpal et al, "Single Chain Insulins as Receptor Agonists", Molecular Endocrinology, vol. 23, No. 5, Feb. 19, 2009 p. 679-688.

Garcia-Aparicio et al., "Design and Discovery of a Novel Dipeptidyl-peptidase IV (CD26)-Based Prodrug Approach", J. Med. Chem. 49: 5339-5351 (2006).

Gelfanov, et al., Discover and Structural Optimization of High Affinity Co-Agonists at the Glucagon and GLP-1 Receptors, Understanding Biology Using Peptides, Springer, pp. 763-764, Jun. 23, 2005.

GenBank entry AAH05278, Jul. 15, 2006 [http:www/ncbi.nim.nih.gov/protein/13528972>].

Gershonov et al, A Novel Approach for a Watter-Soluble long Acting Insulin Prodrug . . . , J. Med. Chem (2000) vol. 43, pp. 2530-2537.

Gysin et al., "Design and Synthesis of Glucagon Partial Agonists and Antagonists," Biochemistry, 25, (1986), pp. 8278-8284.

Habi, "Special Issue: Program and Abstracts for the 19th American Peptide Symposium, 2005, Abstracts of Poster Section C," (pp. 574-603) Article first published online: Jun. 10, 2005 | DOI: 10.1002/bip.20325.

Hamel et al "Cyclosporin a prodrugs: Design, systhesis and biophysical properties", J. Peptide Research, vol. 63 No. 2 pp. 147-154 (Feb. 2004).

Han et al., "IGF-based Insulin Analogs with an A-Chain Lactam," APS poster presentation, 2011.

Hansen et al., "Incretin hormones and insulin sensitivity," Trends in Endocrinology and Metabolism, vol. 16, No. 4, May/Jun. 2005, pp. 135-136.

Harris, J. Milton, Final Word: PEGylation—A "Sunset" Technology? <http://licence.icopyright.net/user/viewFreeUse.act?fuid=OTU1NjY3O%3D%3D>, BioPharm International, Jun. 1, 2004.

Hinds et al, Advancec Drug Delivery Reviews 2002, (54) 505-530 (Jun. 17, 2002).

Hiroshi Ogawa et al "N-Methylation of sleeted peptide bonds on the biological activity of insulin", International J of Peptide and Protein Research, vol. 30, No. 4, p. 460-473 (Oct. 1987).

Hjorth et al., "glucagon and Glucagon-like Peptide 1: Selective Receptor Recognition via Distinct Peptide Epitopes," The Journal of Biological Chemistry, vol. 269, No. 48, pp. 30121-30124, Dec. 2, 1994.

Hruby et al., "The Design and Biological Activities of Glucagon Agonists and Antagonists, and Their Use in Examining the Mechanisms of Glucose Action," Curr. Med. Chem.-Imm., Endoc. & Metab. Agents, 2001, 1, pp. 199-215.

Hua et al, J of Bilogical Chemistry, Mar. 2008, vol. 283, No. 21, 14703-14716 (May 23, 2008).

Irwin et al., "Early administration of the glucose-dependent insulinotropic polypeptide receptor antagonist (Pro³) GIP prevents the development of diabetes and related metabolic abnormalities associated with genetically inherited obesity in ob/ob mice," Diabetologia 50:1532-1540 (2007).

Jen Holst "The Physiology of Glucagon-like Peptide-1", Physiological Reviews, V. 87, No. 4, pp. 1409-1439 (Oct. 2007).

Joost, H.G., et al., Quantitative Dissociation of Glucose-Transport Stimulation and Insulin-Receptor Tyrosine Kinase Activation in Isolated Adipocytes with a Covalent Insulin Dimer (B29,B29'-Sunberoyl-Insulin). Biochemical Pharmacology, 1989. 38(14): p. 2269-2277.

(56) References Cited

OTHER PUBLICATIONS

Joshi et al, "Studies on the Mechanism of Aspartic Acid Cleavage and Glutamine Deamidation in the Acidic Degradation of Glucagon," *Journal of Pharmaceutical Sciences*, vol. 94, No. 9, Sep. 2005, pp. 1912-1927.
Joshi et al., "The Degradation Pathways of Glucagon in Acidic Solutions," *International Journal of Pharmaceutics*, 203 (2000), pp. 115-125.
Joshi et al., "The Estimation of Glutaminyl Deamidation and Aspartyl Cleavage Rates in Glucagon," *International Journal of Pharmaceutics*, 273 (2004), pp. 213-219.
Kaur et al., "Novel Single Chain Insulin Analogs Consisting of a Non-Peptide Based Connection," APS poster presentation, May 12, 2011.
Kristensen et al., "Alanine Scanning Mutagenesis of Insulin," The Journal of Biological Chemistry, 1997, 272(20):12978-12983.
Krstenansky et al., "Importance of the C-terminal α-helical structure for glucagon's biological activity," Int. J. Peptide Protein Res., 32, 1988, 468-475.
Kukuch, A.; Patterson, J.; DiMarchi, R. and Tolbert, T. Immunoglobulin Fc-based Peptide Fusion Proteins as a Basis for Optimizing In Vivo Pharmacology, (2009) Proceedings of the 21$^{st}$ American Peptide Society 177-178.
Kulkarni, "GIP: No Longer the Neglected Incretin Twin?," Science Translational Medicine 2(49): p. 47, Sep. 15, 2010.
Kurapkat et al "Inactive conformation of an insulin despite its wild-type sequence", Protein Science, vol. 6, No. 3, pp. 580-587 (Mar. 1997).
Lee et al., "Synthesis, Characterization, and Pharmacokinetic Studies of PEGylated Glucagon-like Peptide-1," *Bioconjugate Chem.*, 2005, vol. 16, No. 2, pp. 377-382.
Levy et al., Optimization of the C-terminal Sequence in Glucagon to Maximize Receptor Affinity, *Understanding Biology Using Peptides*, American Peptide Society, Apr. 2006.
Li et al., Crystallization and preliminary X-ray analysis of anti-obesity peptide hormone oxyntomodulin, *Protein & Peptide Letters*, 15(2):232-4 (2008).
Li et al., Design, synthesis and crystallization of a novel glucagon analog as a therapeutic agent, *Acta Crystallogr. Sect. F Struct. Biol. Cryst. Commun.*, 63(Pt 7):599-601, Jun. 15, 2007.
Li et al., Structural Basis for Enhanced Solublity of a C-Terminally Extended Glucagon Analog, *Biopolymers.*, 96(4): 480 (2011).
M.J. Roberts et al., "Chemistry for Peptide and Protein PEGylation," Advance Drug Delivery Reviews, Elsevier BV, Amsterdam, NL, vol. 54, No. 4, Jun. 17, 2002, pp. 459-476.
Ma, T.; Day, J.; Gelfanov, V. and DiMarchi, R. Discovery and Structural Optimization of High Affinity Co-Agonists at the Glucagon and GLP-1 Receptors, (2009) Proceedings of the 21$^{st}$ American Peptide Society 146-147.
Madsen et al., "Structure—Activity and Protraction Relationship of Long-Acting Glucagon-like Peptide-1 Derivatives: Importance of Fatty acid Length, Polarity, and Bulkiness," J. Med. Chem. 2007, 50, pp. 6126-6132.
Marita P. Feldkaemper et al., "Localization and Regulation of Glucagon Receptors in the Chick Eye and Preproglucagon and Glucagon Receptor Expression in the Mouse Eye," Experimental Eye Research, Academic Press Ltd., London, vol. 79, No. 3, Sep. 1, 2004, pp. 321-329.
Mayer et al., Insulin Structure and Function, Peptide Science 2007, 88(5):687-713.
McKee et al., Receptor Binding and Adenylate Cyclase Activities of Glucagon Analogues Modified in the N-Terminal Region, Biochemistry, 25: 1650-6 (1986).
Montrose-Rafizadeh et al., "High Potency Antagonists of the Pancreatic Glucagon-like Peptide-1 Receptor," Journal of Biological Chemistry, 272(34) 21201-21206 (1997).
Murphy, et al., "Potent Long-Acting Alkylated Analogs of Growth Hormone-Releasing Factor," Pept. Res., vol. 1. No. 1, pp. 36-41 (1988).

Nogueiras et al., Direct control of peripheral lipid deposition by CNS GLP-1 receptor signaling is mediated by the sympathetic nervous system and blunted in diet-induced obesity, J. Neurosci., 29(18):5916-25, May 6, 2009.
O'Brien, Assay for DPPIV Activity using Homogenous, Luminescent Method, Cell Notes 2005, 11:8-11. (http://www.promega.com/resources/articles/pubhub/cellnotes/assay-for-dppiv-activity-using-a-homogeneous-luminescent-method/).
Ouyang et al., "Synthesis and Characterization of Peptides with Glucagon Antagonism and GLP-1 Agonism," poster presentation at the 21$^{st}$ American Peptide Symposium (Jun. 7-12, 2009, Bloomington, IN).
Pan et al., "Synthesis of Cetuximab-Immunoliposomes via a Cholesterol-Based Membrane Anchor for Targeting of EGFR," Bioconjugate Chem., 18, pp. 101-108, 2007.
Pan et al., Design of a Long Acting Peptide Functioning as Both a Glucagon-like Peptide-1 Receptor Agonist and a Glucagon Receptor Agonist, *J. Biol. Chem.*, 281(18): 12506-15, Table 1, May 5, 2006.
Patterson et al., A novel human-based receptor antagonist of sustained action reveals body weight control by endogenous GLP-1, *ACS Chem Biol.*, 6(2): 135-45 Nov. 4, 2010.
Patterson et al., Functional association of the N-terminal residues with the central region in glucagon-related peptides, *J. Peptide Sci.*, First published online Jun. 10, 2011.
PCT International Search Report for PCT/US2009/068711 completed by the US Searching Authority on Feb. 4, 2010.
PCT International Search Report for PCT/US2009/068712 completed by the US Searching Authority on Mar. 24, 2010.
PCT International Search Report for PCT/US2011/041601 completed by the US Searching Authority on Nov. 10, 2011.
Perret et al., "Mutational analysis of the glucagon receptor: similarities with the vasoactive intestinal peptide (VIP)/pituitary adenylate cyclase-activating peptide (PACAP)/secretin receptors for recognition of the ligand's third residue," J. Biochem., 362 (2002), pp. 389-394.
Phillips et al., "Supramolecular protein engineering: design of zinc-stapled insulin hexamers as a long acting depot," J. Biol. Chem., Apr. 16, 2010, vol. 285, No. 16, pp. 11755-11759.
Reuter, T. Y Diet-induced models or obesity and type 2 diabetes. Drug Discovery Today: Disease Models, vol. 4/1:3-8 (2007).
Robberecht, P. et al., "Receptor Occupancy and Adenylate Cyclase Activation in Rat Liver and Heart Membranes by 10 Glucagon Analogs Modified in Position 2, 3, 4, 25, 27 and/or 29," Regulatory Peptides, 21 (1988), 117-128.
Sapse et al., The Role of Sale Bridge Formation in Glucagon: An Experimental and Theoretical Study of Glucagon Analogs and Peptide Fragments of Glucagon, *Molec. Med.*, 8(5): 251-62, May 1, 2002.
Sato, H., "Enzymatic procedure for site-specific pegylation of proteins," Advanced Drug Delivery Reviews 54, pp. 487-504 (2002).
Schafmeister et al., "An All-Hydrocarbon Cross-Linking System for Enhancing the Helicity and Metaboli Stability of Peptides", *J. Am. Chem. Soc.* 122: 5891-5892 (2000).
Schilling et al., "Degradation of Insulin by Trypsin and Alphachymotrypsin," Pharmaceutical Research 1991, 8(6):721-727 (abstract).
Shechter et al , "Albumin-insulin conjugate releasing insulin slowly under physiologiacal conditions: a new concept for long-acting insulin", Bioconjugate Chemistry vol. 16, No. 4, p. 913-920 (Jul.-Aug. 2005).
Shechter et al , "Reversible pegylation of insulin facilitates its prolonged action in vitro", Eur. J. Pharm. and Biopharm. 70 (Apr. 7, 2008) p. 19-28.
Shojaee-Moradie, F., et al., Demonstration of a Relatively Hepatoselective Effect of Covalent Insulin Dimers on Glucose-Metabolism in Dogs. Diabetologia, 1995. 38(9): p. 1007-1013.
Stigsnaes et al., "Characterisation and Physical Stability of PEGylated Glucagon," *International Journal of Pharmaceutics*, 330 (2007), pp. 87-98.

(56) References Cited

OTHER PUBLICATIONS

Sturm et al., "Structure-Function Studies on Positions 17, 18, and 21 Replacement Analogues of Glucagon: The Importance of Charged Residues and Salt Bridges in Glucagon Biological Activity," J Med Chem 1998, 41, 2693-2700.

Suaifan et al., "Effects of steric bulk and stereochemistry on the rates of diketopiperazine formation from N-aminoacyl-2,2-dimethylthiazolidine-4-carboxamides (Dmt dipeptide amides)—a model for a new prodrug linker system," Tetrahedron 62, (2006), pp. 11245-11266.

Sueiras-Diaz et al., "Structure-Activity Studies on the N-Terminal Region of Glucagon," J. Med. Chem., 27, pp. 310-315, 1984.

Tatnell, M.A., et al., Evidence Concerning the Mechanism of Insulin-Receptor Interaction and the Structure of the Insulin-Receptor from Biological Properties of Covalently Linked Insulin Dimers. Biochemical Journal, 1983. 216(3): p. 687-694.

Traylor et al., Identification of the High Potency Glucagon Agonist with Enhanced Biophysical Stability and Aqueous Solubility, Poster Abstract PY 10, pp. 505-506, Jun. 10, 2005.

Trivedi, D. et al., Design and synthesis of conformationally constrained glucagon analogues, J. Med. Chem., 43(9): 1714-22, May 4, 2000 (Abstract).

Tschoep et al., A Novel Glucagon/GLP-1 Co-Agonist Eliminates Obesity in Rodents, Diabetes, 58 (Supp. 1): A83 (2009).

Tschoep, "CNS Integration of Systems Metabolism: Target Opportunities for Diabetes Prevention and Therapy," RBF Symposium Feb. 1-4, 2011 India.

Unson et al., "Glucagon antagonists: Contribution to binding and activity of the amino-terminal sequence 1-5, position 12 and the putative alpha-helical segment 19-27," J. Biol. Chem. v264, pp. 789-794, Jan. 15, 1989, p. 792, para 1, Table 1.

Unson et al., "Role of Histidine-1 in Glucagon Action," Archives of Biochemistry and Biophysics, vol. 300, No. 2, pp. 747-750, Feb. 1, 1993.

Unson et al., Positively Charged Residues at Positions 12, 17, and 18 of Glucagon Ensure Maximum Biological Potency, J. Biol. Chem., 273(17): 10308-12 (1998).

Vijayalakshmi et al., "Comparison of Helix-Stabilizing Effects of α, α-dialkyl Glycines with Linear and Cycloalkyl Side Chains", Biopolymers 53:84-98 (Jan. 21, 2000).

Wang et al., "Identification of Site(s) of Insulin Nitration by Peroxynitrite and Characterization of its Structural Change," Protein & Peptide Letters 2008, 15:1063-1067.

Ward et al., In vitro and in vivo evaluation of native glucagon and glucagon analog (MAR-D28) during aging: lack of cytotoxicity and preservation of hyperglycemic effect, J. Diabetes Sci. Technol., 4(6):1311-21, Nov. 1, 2010.

Ward, "Fatty Acid Acylation of Peptides: Developing strategies to enhance medicines for treating metabolic disorders," Jan. 14, 2009.

Ward, B.; Finan, B.; Gelfanov, V. and DiMarchi, R. Exploring the N-terminal Hydrophobic Faces of Glucagon and Glucagon-like Peptide-1, (2009) Proceedings of the 21st American Peptide Society 153-154.

Weiland et al, "Antagonistic effects of a covalently dimerized insulin derivatized insulin derivative on insulin receptors in 3T3-L1 adipocytes", PNAS, vol. 87, pp. 1154-1158, Feb. 1990.

Wibowo, Synthesis, Purification, and Biological Activity of AIB Substituted Glucagon and GLP-1 Peptide Analogues (2005-2006) vol. 45, 707=738, accessed https://scholarworks.iu.edu/dspce/handle/2022/326 on Jul. 17, 2012.

Worrall et al "Synthesis of an organoinsulin molecule tha tcan be activated by antibody catalysis", PNAS vol. 98, No. 24, p. 13514-13518 (Nov. 20, 2001).

Wynne et al., "Subcutaneous Oxyntomodulin Reduces Body Weight in Overweight and Obese Subjects," Diabetes, vol. 54, Aug. 2005, pp. 2390-2395.

Yang et al, "Relationship between insulin A chain regions and insulin biological activities," World J. of Gastroentero, 2000: 6(3): 371-373 (Jun. 2000).

Yang et al., "A Novel Approach to Resin-Based Cysteine Alkylation," poster presentation to American Peptide Society, 2005.

Yang et al., "Synthesis and Biological Assessment of Sulfonic Acid-Based Glucagon Antagonists," American Peptide Society, 2005.

Yang et al., "Synthesis and Biological Assessment of Sulfonic Acid-Based Glucagon Antagonists," poster presentation to American Peptide Society, 2005.

Yang et al., Synthesis and Biological Assessment of Sulfonic Acid-Based Glucagon Antagonists, Understanding Biology Using Peptides, American Peptide Symposia, 9(Part 6): 305-6 (2006).

Yang, B. and DiMarchi, R.D. (2005). A Novel Approach to Resin-based Cysteine Alkylation Peptides: Chemistry, Structure and Biology, Proceedings of the XIX American Peptide Symposium, (88-89).

Zhang et al., Design and synthesis of novel GLP1 analogues with significantly prolonged time action, Biopolymers., 80(4): 555 (2005).

Zhao et al., "Improved Pharmacokinetics through Site-Specific PEGylation of Insulin Analogs," APS poster presentation, 2011.

Zhou et al., "Peptide and protein drugs: I. Therapeutic applications, absorption and parenteral administration," International Journal of Pharmaceutics vol. 75 p. 97-111 (Sep. 20, 1991).

Schuttler, A. and D. Brandenburg, Preparation and Properties of Covalently Linked Insulin Dimers. Hoppe-Seylers Zeitschrift Fur Physiologische Chemie, 1982. 363(3): p. 317-330.

Roth, R.A., et al., Effects of Covalently Linked Insulin Dimers on Receptor Kinase-Activity and Receptor down Regulation. Febs Letters, 1984. 170(2): p. 360-364.

Tatnell, M.A., R.H. Jones, and P.H. Sonksen, Covalently-Linked Insulin Dimers—Their Metabolism and Biological Effects Invivo as Partial Competitive Antagonists of Insulin-Clearance. Diabetologia, 1984. 27(1): p. 27-31.

Deppe, C., et al., Structure-Activity Relationship of Covalently Dimerized Insulin Derivatives—Correlation of Partial Agonist Efficacy with Cross-Linkage at Lysine B29. Naunyn-Schmiedebergs Archives of Pharmacology, 1994. 350(2): p. 213-217.

Höcker, H., C. Havenith, and D. Brandenburg, Covalently Bridged Insulin Dimers. 2009, EP Patent 1,161,452.

Finan, B. et al., Targeted estrogen delivery reverses the metabolic syndrome, Nat. Med., 2012, vol. 18, pp. 1847-1856 (Abstract).

Synthetic "A⁷-B⁷"-derived Insulin Receptor Binding

Fig. 5

A-Chain

```
              1                     21
Insulin    GIVEQCCTSICSLYQLENYCN
IGF I      ---DE--FRS-D-RR--M--A
IGF II     ----E--FRS-D-AL--T--A
```

B-Chain

```
              1                              30
Insulin    FVNQHLCGSHLVEALYLVCGERGFFYTPKT
IGF I      *GPET---AE---D---QF----D---YFNKP-
IGF II     AYRPSET---GE--DT-QF----D---YFSRPA
```

C-Chain

```
              1                                          35
Proinsulin  RREAEDLQVGQVELGGGPGAGSLQPLALEGSLQKR
IGF I       GYGSSSRRAPQT
IGF II      SRVSRRSR
```

D-Chain

```
           1        8
           ********
IGF I      PLKPAKSA
IGF II     *T*PAKSE
```

FIG. 6

GLP1-DP8 mut7 Analogs

*Designed Activity*

1. GLP-1 Parent Peptide
HAEGTFTSDVSSYLEEQAAREFIAWLVRGRG
GPEHLCGAHLVDALYLVCGDRGFYFNDRGAGSSSRRGIVDECCHRSCDLRRLENYCN   IR⁺  GLP1R⁺

2. GLP-Insulin A-chain Ala¹⁹
HAEGTFTSDVSSYLEEQAAREFIAWLVRGRG
GPEHLCGAHLVDALYLVCGDRGFYFNDRGAGSSSRRGIVDECCHRSCDLRRLEN<u>A</u>CN   IR⁻  GLP1R⁺

3. GLP1 Ala²²
HAEGTFTSDVSSYLEEQAARE<u>A</u>IAWLVRGRG
GPEHLCGAHLVDALYLVCGDRGFYFNDRGAGSSSRRGIVDECCHRSCDLRRLENYCN   IR⁺  GLP1R⁻

Glucagon-DP8 mut7 Analogs

*Designed Activity*

4. Glucagon Parent Peptide
HSQGTFTSDYSKYLDSRRAQDFVQWLMNT
GPEHLCGAHLVDALYLVCGDRGFYFNDRGAGSSSRRGIVDECCHRSCDLRRLENYCN   IR⁺  GluR⁺

5. Glucagon-Insulin A-chain Ala¹⁹
HSQGTFTSDYSKYLDSRRAQDFVQWLMNT
GPEHLCGAHLVDALYLVCGDRGFYFNDRGAGSSSRRGIVDECCHRSCDLRRLEN<u>A</u>CN   IR⁻  GluR⁺

6. Glucagon E³
HS<u>E</u>GTFTSDYSKYLDSRRAQDFVQWLMNT
GPEHLCGAHLVDALYLVCGDRGFYFNDRGAGSSSRRGIVDECCHRSCDLRRLENYCN   IR⁺  GluR⁻

7. Glucagon E¹⁶
HSQGTFTSDYSKYLD<u>E</u>RRAQDFVQWLMNT
GPEHLCGAHLVDALYLVCGDRGFYFNDRGAGSSSRRGIVDECCHRSCDLRRLENYCN   IR⁺  GluR⁺  GLP1-R⁺

FIG. 7

In Vitro Analysis of GLP1-DP8 mut7 Fractions

*EC50 Values (nM) – Receptor Signaling*

Insulin Receptor

Pool#1 =  0.79 ±0.34

Pool#2 = 14.07 ±3.18

Pool#4 = 18.84 ±5.69

Insulin = 1.04 ±0.28

IGF-1   =  6.79 ±2.04

GLP-1 Receptor

Pool#1 = 0.005 ±0.001

Pool#2 = 0.004 ±0.001

Pool 4 = 0.023 ±0.001

Insulin = >2,000 ±500

GLP-1  = 0.009 ±0.002

FIG. 8

In Vitro Analysis of Glucagon-DP8 mut7 Fractions

*EC50 Values (nM) – Receptor Signaling*

| Insulin Receptor | Glucagon Receptor | GLP-1 Receptor |
|---|---|---|
| Pool#1 = 1.02 ±0.14 | Pool#1 = 0.066±0.017 | Pool#1 = 10.09 ±38.3 |
| Pool#2 = >20.0 ±10.0 | Pool#2 = >20.0 ±10.0 | Pool#2 = >20.0 ±10.0 |
| Pool#3 = 9.31 ±2.78 | Pool#3 = 0.043 ±0.013 | Pool#3 = 16.26±22.3 |
| Insulin = 0.07 ±0.17 | Glucagon = 0.032 ±0.06 | GLP-1 = 0.006 ±0.001 |
| IGF-1 = 9.96 ±2.40 | | |

FIG. 10

In Vitro Analysis of GLP1 DP8 mut7 Hybrids

Insulin Receptor

| | Insulin Receptor |
|---|---|
| Insulin | 0.227 ± 0.029 |
| GLP-1 | >100 |
| GLP1/DP8 mut 7 | 0.542 ± 0.164 |
| GLP1/DP8 mut 7(A$^{19}$) | 28.9 ± 9.9 |

FIG. 11

In Vitro Analysis of Glucagon DP8 mut7 Hybrids

Insulin Receptor

| | Insulin Receptor |
|---|---|
| Insulin | 0.091 ± 0.014 |
| Glucagon | >100 |
| Glucagon/DP8 mut 7 | 0.093 ± 0.062 |
| Glucagon/DP8 mut 7(A$^{19}$) | >100 |
| Glucagon(E$^3$)/DP8 mut 7 | 0.125 ± 0.069 |
| Glucagon(E$^{16}$)/DP8 mut 7 | 0.159 ± 0.128 |

FIG. 12

In Vitro Analysis of GLP1 & Glucagon DP8 mut7 Hybrids

Glucagon Receptor

| | Glucagon Receptor |
|---|---|
| Glucagon | 0.025 ± 0.004 |
| Glucagon/DP8 mut 7 | 0.087 ± 0.007 |
| Glucagon(E$^{16}$)/DP8 mut 7 | 0.113 ± 0.008 |
| Glucagon(E$^{3}$)/DP8 mut 7 | 3.160 ± 0.425 |
| Glucagon/DP8 mut 7(A$^{19}$) | 0.076 ± 0.010 |
| GLP1/DP8 mut 7 | 3.290 ± 0.398 |

FIG. 13

In Vitro Analysis of GLP1 & Glucagon DP8 mut7 Hybrids

GLP-1 Receptor

| | GLP-1 Receptor |
|---|---|
| GLP-1 | 0.025 ± 0.005 |
| GLP1/DP8 mut 7 | 0.002 ± 0.007 |
| GLP1($A^{22}$)/DP8 mut 7 | 2.242 ± 0.603 |
| GLP1/DP8 mut 7($A^{19}$) | 0.003 ± 0.001 |
| Glucagon/DP8 mut 7 | 2.679 ± 0.201 |
| Glucagon($E^{16}$)/DP8 mut 7 | 1.349 ± 0.120 |

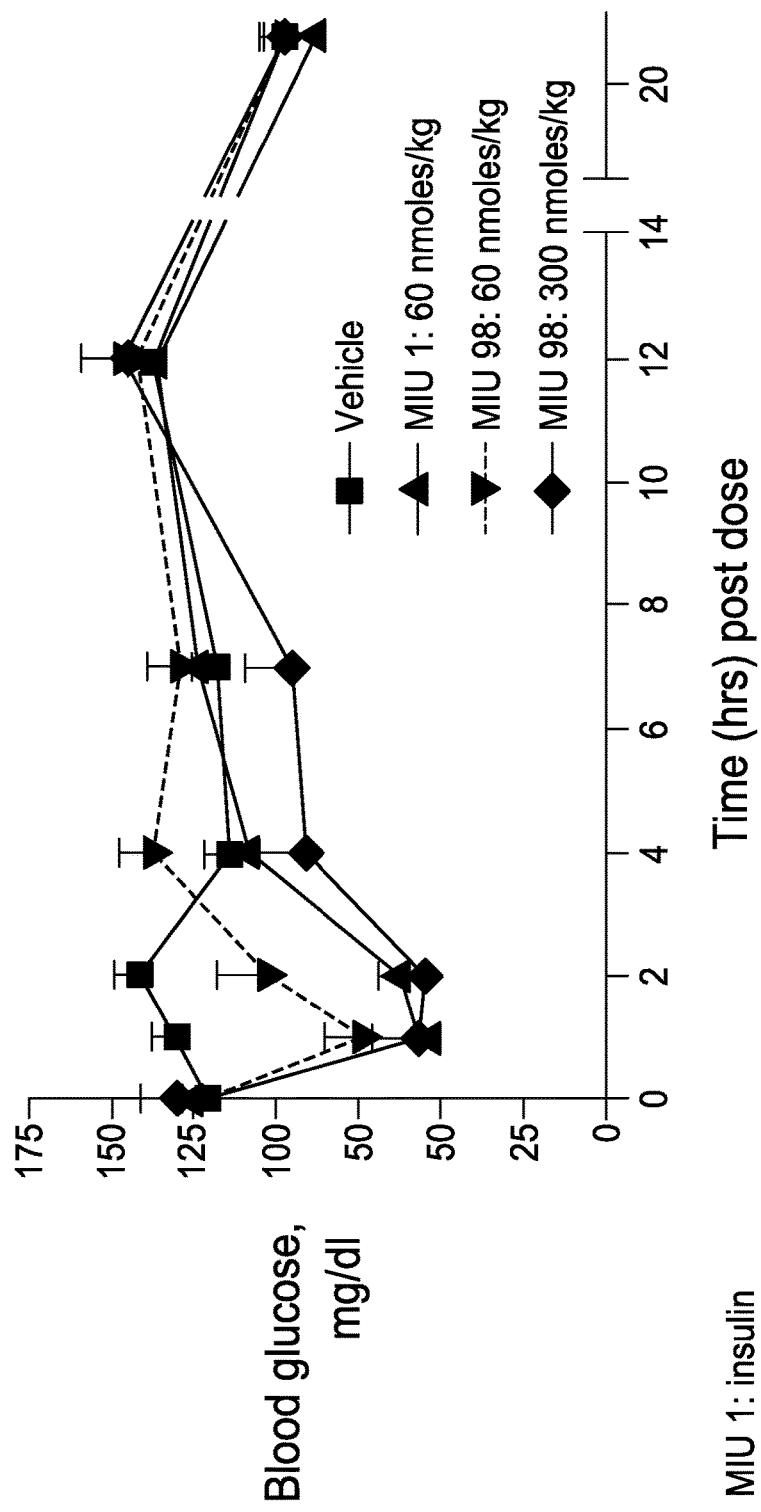

INSULIN-INCRETIN CONJUGATES

CROSS-REFERENCE TO RELATED APPLICATIONS

This application claims priority to U.S. application Ser. No. 14/774,357, filed on Sep. 10, 2015, which is a U.S. national counterpart application of PCT/US2014/020801, filed Mar. 5, 2014, which claims priority to U.S. Provisional Patent Application No. 61/783,491, filed Mar. 14, 2013, the contents of which are incorporated by reference in their entirety into the present application.

INCORPORATION BY REFERENCE OF MATERIAL SUBMITTED ELECTRONICALLY

Incorporated by reference in its entirety is a computer-readable sequence listing submitted concurrently herewith and identified as follows: one 983 KB ASCII (text) file named "273792SEQList_ST25.txt", created on Dec. 18, 2017.

BACKGROUND

Insulin is a proven therapy for the treatment of juvenile-onset diabetes and later stage adult-onset diabetes. The peptide is biosynthesized as a larger linear precursor of low potency (approximately 2% to 9% of native insulin), named proinsulin. Proinsulin is proteolytically converted to insulin by the selective removal of a 35-residue connecting peptide (C peptide). The resultant heteroduplex formed by disulfide links between the insulin "A chain" (SEQ ID NO: 1) and "B chain" (SEQ ID NO: 2) chain, representing a total of 51 amino acids, has high potency for the insulin receptor (nM range). Native insulin has approximately one hundredfold selective affinity for the insulin receptor relative to the related insulin-like growth factor 1 receptor, but demonstrates little selectively for the two different insulin receptor isoforms, named A & B.

The insulin-like growth factors 1 and 2 are single chain liner peptide hormones that are highly homologous in their A and B chain sequences, sharing approximately fifty percent homology with native insulin. The IGF A and B chains are linked by a "C-peptide", wherein the C-peptides of the two IGFs differ in size and amino acid sequence, the first being twelve and the second being eight amino acids in length. Human IGF-1 is a 70 aa basic peptide having the protein sequence shown in SEQ ID NO: 3, and has a 43% homology with proinsulin (Rinderknecht et al. (1978) J. Biol. Chem. 253:2769-2776). Human IGF-2 is a 67 amino acid basic peptide having the protein sequence shown in SEQ ID NO: 4. The IGFs demonstrate considerably less activity at the insulin B receptor isoform than the A-receptor isoform.

Applicants have previously identified IGF-1 based insulin peptides analogs, (wherein the native Gln-Phe dipeptide of the B-chain is replaced by Tyr-Leu) that display high activity at the insulin receptor (see PCT/US2009/068713, the disclosure of which is incorporated herein). Such analogs (referred to herein as IGF YL analog peptides) are more readily synthesized than insulin and enable the development of co-agonist analogs for insulin and IGF-1 receptors, and selective insulin receptor specific analogs. Furthermore, these insulin analogs can also be formulated as single chain insulin agonists in accordance with the present disclosure.

Single chain insulin analogs comprising the insulin A and B chains have been previously prepared (see EP 1,193,272 and US 2007/0129284). However, single chain high potency insulin agonists can also be prepared by insertion of the IGF-1 C-peptide, or analogs thereof, as a connecting peptide linking the insulin B and A peptides. The selective mutation of individual amino acids in the C-peptide sequence yields peptides that are highly selective for insulin relative to IGF-1 receptor.

Incretins are a group of gastrointestinal hormones that that are involved in a wide variety of physiological functions, including glucose homeostasis, insulin secretion, gastric emptying, and intestinal growth, as well as the regulation of food intake. Pre-proglucagon is a 158 amino acid precursor polypeptide that is processed in different tissues to form a number of different peptides. Incretins include a number of proglucagon-derived peptides, including glucagon (SEQ ID NO: 701), glucagon-like peptide-1 (GLP-1; amino acids 7-36 are provided as SEQ ID NO: 703 and amino acids 7-35 as SEQ ID NO: 704), glucagon-like peptide-2 (GLP-2; SEQ ID NO: 708) and oxyntomodulin (OXM; SEQ ID NO: 706).

Glucagon is a 29-amino acid peptide that corresponds to amino acids 33 through 61 of pre-proglucagon, while GLP-1 is produced as a 37-amino acid peptide that corresponds to amino acids 72 through 108 of pre-proglucagon. GLP-1(7-36) amide (SEQ ID NO: 703; the C terminus is an arginine amide) or GLP-1(7-37) acid (SEQ ID NO: 704; C terminus is a glycine) are biologically potent forms of GLP-1, that demonstrate essentially equivalent activity at the GLP-1 receptor.

Glucagon is a life-saving medicine that is used in the acute treatment of severe hypoglycemia. Oxyntomodulin has been reported to have pharmacological ability to suppress appetite and lower body weight. Clinical studies with GLP-1 receptor agonists or stabilized GLP-1 analogs have proven this family of peptides to be an effective treatment for Type II diabetes.

In addition, gastric inhibitory polypeptide (GIP) is also known as a glucose-dependent insulinotropic peptide, and is a member of the secretin family of hormones. GIP is derived from a 153-amino acid proprotein encoded by the GIP gene and circulates as a biologically active 42-amino acid peptide (SEQ ID NO: 707). The GIP gene is expressed in the small intestine as well as the salivary glands and is a weak inhibitor of gastric acid secretion. In addition to its inhibitory effects in the stomach, in the presence of glucose, GIP enhances insulin release by pancreatic beta islet cells when administered in physiological doses. GIP is believed to function as an enteric factor that stimulates the release of pancreatic insulin and that may play a physiological role in maintaining glucose homeostasis.

As disclosed herein conjugates are formed between an insulin peptide and an incretin, including for example a glucagon related peptide, wherein the conjugate has agonist activity at both the insulin receptor and the corresponding incretin receptor. More particularly, the conjugation of a glucagon related peptide (e.g., GIP, GLP-1 or glucagon) is anticipated to produce a beneficial modification of the insulin peptide activity. For example, linking a peptide having agonist activity at the glucagon receptor to an insulin peptide is anticipated to enhance targeting of the conjugate to the liver since the glucagon receptor is predominately located in the liver. Targeting of the conjugate to the liver is desirable since the liver is primarily involved in glucose production not utilization. Thus targeting the liver may be a safer approach to shutting off glucose production than occurs when insulin contact other tissues such as muscle or fat, where in addition to turning off glucose production it also stimulates glucose use leading to a higher risk of hypoglycemia. Also, there are glucagon receptors present on the alpha cells of the pancreas. Delivering the complex to the alpha cells may suppress additional glucagon production or make the alpha cell more sensitive to hypoglycemia. Applicants also anticipate that the presence of glucagon in the glucagon-insulin conjugates may serve as a buffer on the activity of the coupled insulin to provide a more baseline activity and thus avoid spikes in blood glucose levels.

Similarly, it is anticipated that conjugates of insulin peptides with other glucagon related peptides including the incretins GLP-1 and GIP and other related peptides having activity at the GLP-1 and/or GIP receptors will produce conjugates having beneficial properties. For example, GLP-insulin conjugate may be targeted to the hypothalamus, to decrease appetite as well as reduce blood glucose. Alternatively or additionally, the GLP-insulin conjugate may be targeted to the beta cells to drive anabolic response (increase islet beta cells production of insulin).

The glucagon related peptide-insulin peptide conjugates are also suitable for further structural enhancements that are envisioned to yield improved therapeutic index, through the use of prodrug chemistry; extended duration of action, by linkage of plasma proteins such as albumin, or other modifications, including pegylation and acylation; and enhanced physical stability, by glycosylation. The preparation of single chain insulin analogs using a C-peptide linker also provides a novel structural location for where many of these chemical modifications can be successfully deployed. The primary use of the insulin conjugates would be in the treatment of insulin-dependent diabetes.

SUMMARY

An insulin agonist/incretin conjugate is provided wherein the conjugate has agonist activity at both the insulin receptor and the corresponding incretin receptor. The insulin peptide component of the conjugate can be native insulin or any known insulin analog that has activity at the insulin receptor including for example any insulin peptide disclosed in published international applications WO96/34882, WO 2010/080607, WO 2010/080609, WO 2011/159882, WO/2011/159895 and U.S. Pat. No. 6,630,348, the disclosures of which are incorporated herein by reference. The incretin component of the conjugate can be any glucagon related peptide as disclosed herein including for example native glucagon, GLP-1, GIP or any known incretin or glucagon related peptide that has activity at one or more incretin receptors. Glucagon related peptides suitable for use in accordance with this disclosure include, for example, any glucagon related peptide disclosed in published international applications WO 2009/155258, WO 2009/058734, WO 2011/094337, WO 2009/148089, WO 2011/163473 and WO 2010/071807, the disclosures of which are expressly incorporated herein in their entirety.

In accordance with one embodiment the carboxy terminus of a glucagon related peptide is linked to the N-terminus of an insulin peptide either directly via a peptide bond (forming a fusion peptide), or indirectly through a spacer. In accordance with one embodiment conjugates formed by the fusions of glucagon or GLP-1 with insulin are provided that demonstrate high potency, balanced activity at the respective receptors of the conjugate, and glucose lowering capability when injected in normal mice. In one embodiment the C-terminal region of the glucagon related peptides is covalently linked to the insulin peptide through a position independently selected from the side chain of an amino acid at a position selected from the group consisting of A9, A14 and A15 of the A chain, positions B1, B2, B10, B22, B28 or B29 of the B chain, the N-terminal alpha amine of the B chain, the carboxy terminus of the A or B chain and at the side chain of an amino acid at any position of a linking moiety that links the A chain and B chain of a single chain insulin analog.

As used herein reference to the C-terminal region of the glucagon related peptide is intended to encompass the native C-terminus of a glucagon peptide or any amino acid added to the native C-terminus of a glucagon analog or to the C-terminal amino acid of a glucagon analog that has been shortened by the deletion amino acids at the C-terminus, respectively, relative to the native glucagon sequence. For example the C-terminus of the native glucagon related peptide can be extended by 1 to 3 amino acids which are then linked to the insulin peptide either through the side chain of an amino acid of the C-terminal region or through the C-terminal carboxy group. In one embodiment the carboxy terminal region of the glucagon related peptide is covalently linked to the amino terminal region of the B chain of the insulin peptide. In one embodiment the insulin peptide is a single chain insulin analog. In one embodiment the insulin peptide is a single chain insulin analog wherein the carboxy terminal region of the glucagon related peptide is covalently linked to the amino terminus of the B chain of the insulin peptide.

In one embodiment the insulin peptide of the conjugate is a two chain insulin analog comprising an A chain and B chain linked to one another via intermolecular disulfide bonds. In a further embodiment the conjugate comprises a two chain insulin analog wherein a first and second glucagon related peptide are covalently linked to the insulin peptide at a position selected from the group consisting of the amino terminus of the B chain, the carboxy terminal region of the A chain, and the carboxy terminal region of the B chain. In one embodiment the first and second glucagon related peptides have different affinities/selectivity for the glucagon, GLP-1 and GIP receptors.

In one embodiment the glucagon related peptide is selected from the group consisting of native glucagon, native GLP-1 and native GIP. In one embodiment the glucagon related peptide is a native glucagon or a glucagon analog having activity at one or more incretin receptors selected from the glucagon receptor, the GLP-1 receptor or the GIP receptor. In one embodiment the glucagon related peptide component of the conjugate comprises (i) the amino acid sequence:
X1-X2-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Z (SEQ ID NO: 839) with 1 to 3 amino acid modifications thereto, wherein X1 and/or X2 is a non-native (relative to SEQ ID NO: 701) amino acid that reduces susceptibility of the glucagon related peptide to cleavage by dipeptidyl peptidase IV (DPP-IV), Z is selected from the group consisting of —COOH, -Asn-COOH, Asn-Thr-COOH, and Y—COOH, wherein Y is 1 to 2 amino acids, and further wherein (1) a lactam bridge connects the side chains of an amino acid at position i and an amino acid at position i+4, wherein i is 12, 16, 20 or 24 or (2) one, two, three, or all of the amino acids at positions 16, 20, 21, and 24 of the glucagon related peptide is substituted with an α, α-disubstituted amino acid;

and said glucagon related peptide has glucagon agonist activity;

(ii) the amino acid sequence of SEQ ID NO: 701 modified to comprise at least one amino acid modification selected from the group consisting of:
  substitution of Asn at position 28 with a charged amino acid;
  substitution of Asn at position 28 with a charged amino acid selected from the group consisting of Lys, Arg, His, Asp, Glu, cysteic acid, and homocysteic acid;
  substitution at position 28 with Asn, Asp, or Glu;
  substitution at position 28 with Asp;
  substitution at position 28 with Glu;
  substitution of Thr at position 29 with a charged amino acid;
  substitution of Thr at position 29 with a charged amino acid selected from the group consisting of Lys, Arg, His, Asp, Glu, cysteic acid, and homocysteic acid;
  substitution at position 29 with Asp, Glu, or Lys;
  substitution at position 29 with Glu;
  insertion of 1-3 charged amino acids after position 29;
  insertion after position 29 of Glu or Lys;
  insertion after position 29 of Gly-Lys or Lys-Lys; or a combination thereof;
  and at least one amino acid modification selected from Group A or Group B, or a combination thereof;
wherein Group A is an amino acid modification selected from the group consisting of substitution of Asp at position 15 with Glu, and substitution of Ser at position 16 with Thr or AIB; and
wherein Group B is an amino acid modification selected from the group consisting of:
  substitution of His at position 1 with a non-native amino acid that reduces susceptibility of the glucagon related peptide to cleavage by dipeptidyl peptidase IV (DPP-IV),
  substitution of Ser at position 2 with a non-native amino acid that reduces susceptibility of the glucagon related peptide to cleavage by dipeptidyl peptidase IV (DPP-IV),
  substitution of Tyr at position 10 with Phe or Val;
  substitution of Lys at position 12 with Arg;
  substitution of Gln at position 20 with Ala or AIB;
  substitution of Asp at position 21 with Glu;
  substitution of Gln at position 24 with Ala or AIB;
  substitution of Met at position 27 with Leu or Nle;
  deletion of amino acids at positions 27-29;
  deletion of amino acids at positions 28-29;
  deletion of the amino acid at positions 29;
  or a combination thereof;
and wherein said glucagon related peptide has glucagon agonist activity;
(iii) a glucagon related peptide of SEQ ID NO: 701, modified to comprise
  (a) an amino acid modification at position 1 that confers GIP agonist activity,
  (b) (1) a lactam bridge between the side chains of amino acids at positions i and i+4 or between the side chains of amino acids at positions j and j+3, wherein i is 12, 13, 16, 17, 20 or 24, and wherein j is 17, or
    (2) one, two, three, or all of the amino acids at positions 16, 20, 21, and 24 of the analog is substituted with an α,α-disubstituted amino acid,
  (c) amino acid modifications at one, two or all of positions 27, 28 and 29, and
  (d) 1-6 further amino acid modifications,
wherein the EC50 of the analog for GIP receptor activation is about 10 nM or less;
(iv) the sequence of $X_1X_2X_3GTFTSDX_{10}SX_{12}YLX_1X_{16}X_{17}X_{18}AX_{20}X_{21}FX_{23}X_{24}WL\ X_{27}X_{28}X_{29}$ (SEQ ID NO: 72) wherein $X_1$ is selected from the group consisting of His, D-His, (Des-amino)His, hydroxyl-His, acetyl-His, homo-His or alpha, alpha-dimethyl imidiazole acetic acid (DMIA), N-methyl His, alpha-methyl His, and imidazole acetic acid;
$X_2$ is selected from the group consisting of Ser, D-Ser, Ala, D-Ala, Val, Gly, N-methyl Ser, aminoisobutyric acid (Aib) and N-methyl Ala;
$X_3$ is selected from the group consisting of Gln, Glu, Orn and Nle;
$X_{10}$ is selected from the group consisting of Tyr, Val and Trp;
$X_{12}$ is selected from the group consisting of Ser, Lys, Citrulline, Orn and Arg;
$X_{15}$ is selected from the group consisting of Asp, Glu, cysteic acid, homoglutamic acid and homocysteic acid;
$X_{16}$ is selected from the group consisting of Ser, Gly, Glu, Gln, homoglutamic acid and homocysteic acid;
$X_{17}$ is selected from the group consisting of Arg, Gln, Lys, Cys, Orn, homocysteine and acetyl phenylalanine;
$X_{18}$ is selected from the group consisting of Arg, Ala, Lys, Cys, Orn, homocysteine and acetyl phenylalanine;
$X_{20}$ is selected from the group consisting of Gln, Lys, Arg, Orn and Citrulline;
$X_{21}$ is selected from the group consisting of Gln, Glu, Asp, Lys, Cys, Orn, homocysteine and acetyl phenylalanine;
$X_{23}$ is selected from the group consisting of Val and Ile;
$X_{24}$ is selected from the group consisting of Ala, Gln, Glu, Lys, Cys, Orn, homocysteine and acetyl phenylalanine;
$X_{27}$ is selected from the group consisting of Met, Val, Leu and Nle;
$X_{28}$ is selected from the group consisting of Asn, Arg, Citrulline, Orn, Lys and Asp; and
$X_{29}$ is selected from the group consisting of Thr, Gly, Lys, Cys, Orn, homocysteine and acetyl phenylalanine; or an analog of SEQ ID NO: 72, wherein said analog differs from SEQ ID NO: 72 by 1 to 3 amino acid modifications, selected from positions 1, 2, 3, 5, 7, 10, 11, 13, 14, 17, 18, 19, 21, 24, 27, 28, and 29, wherein said glucagon related peptide exhibits at least 20% of the activity of native GLP-1 at the GLP-1 receptor;
(v) an amino acid that differs from SEQ ID NO: 701 by no more than ten amino acid modifications, comprising one or more amino acid substitutions with AIB at positions 16, 20, 21, and/or 24, and an amino acid modification at position 1 and/or 2 that provides reduced susceptibility to cleavage by dipeptidyl peptidase IV, wherein said glucagon related peptide exhibits at least 20% of the activity of native GLP-1 at the GLP-1 receptor.

In one embodiment the insulin peptide of the conjugate comprises an A chain and a B chain wherein said A chain comprises a sequence $GIVX_4X_5CCX_8X_9X_{10}CX_{12}LX_{14}X_{15}LX_{17}X_{18}YCX_{21}\text{-}R_{13}$ (SEQ ID NO: 19), and said B chain comprises a sequence $R_{22}\text{-}X_{25}LCGX_{29}X_{30}LVX_{33}X_{34}LYLVCGX_{41}X_{42}GFX_{45}$ (SEQ ID NO: 20), wherein
$X_4$ is glutamic acid or aspartic acid;
$X_5$ is glutamine or glutamic acid
$X_8$ is histidine, threonine or phenylalanine;
$X_9$ is serine, arginine, lysine, omithine or alanine;
$X_{10}$ is isoleucine or serine;
$X_{12}$ is serine or aspartic acid;
$X_{14}$ is tyrosine, arginine, lysine, omithine or alanine;
$X_{15}$ is glutamine, glutamic acid, arginine, alanine, lysine, ornithine or leucine;
$X_{17}$ is glutamic acid, aspartic acid, asparagine, lysine, ornithine or glutamine;

$X_{18}$ is methionine, asparagine, glutamine, aspartic acid, glutamic acid or threonine;

$X_{21}$ is selected from the group consisting of alanine, glycine, serine, valine, threonine, isoleucine, leucine, glutamine, glutamic acid, asparagine, aspartic acid, histidine, tryptophan, tyrosine, and methionine;

$X_{25}$ is histidine or threonine;

$X_{29}$ is selected from the group consisting of alanine, glycine and serine;

$X_{30}$ is selected from the group consisting of histidine, aspartic acid, glutamic acid, homocysteic acid and cysteic acid;

$X_{33}$ is selected from the group consisting of aspartic acid and glutamic acid;

$X_{34}$ is selected from the group consisting of alanine and threonine;

$X_{41}$ is selected from the group consisting of glutamic acid, aspartic acid or asparagine;

$X_{42}$ is selected from the group consisting of alanine, ornithine, lysine and arginine;

$X_{45}$ is tyrosine or phenylalanine;

$R_{22}$ is selected from the group consisting of AYRPSE (SEQ ID NO: 14), FVNQ (SEQ ID NO: 12), PGPE (SEQ ID NO: 11), a tripeptide glycine-proline-glutamic acid, a tripeptide valine-asparagine-glutamine, a dipeptide proline-glutamic acid, a dipeptide asparagine-glutamine, glutamine, glutamic acid and an N-terminal amine; and $R_{13}$ is COOH or $CONH_2$. In one embodiment the conjugate comprises a sequence selected from the group consisting of SEQ ID NO: 132, SEQ ID NO: 135, SEQ ID NO: 139 and SEQ ID NO: 140 or an analog thereof that differs from SEQ ID NO: 132, SEQ ID NO: 135, SEQ ID NO: 139 or SEQ ID NO: 140 by 1, 2, 3, 4 or 5 amino acid modifications. In one embodiment the conjugate comprises a sequence that differs from SEQ ID NO: 132, SEQ ID NO: 135, SEQ ID NO: 139 or SEQ ID NO: 140 by 1, 2 or 3 amino acid substitutions.

In one embodiment the glucagon related peptide-insulin conjugate comprises a hydrophilic moiety linked to the N-terminal alpha amine of the B chain or to the side chain of an amino acid at a position selected from the group consisting of A9, A14 and A15 of the A chain or positions B1, B2, B10, B22, B28 or B29 of the B chain or to a side chain of an amino acid of the linking moiety in a single chain insulin analog. Alternatively, or in addition, a hydrophilic moiety can be linked to the glucagon related peptide at any of amino acid positions 19, 20, 23, 24, 27, 32, 43 or the C-terminal region.

In one embodiment the hydrophilic moiety is a polyethylene chain and in a further embodiment the polyethylene chain is covalently bound to the side chain of an amino acid of the linking moiety of the insulin peptide component, when the insulin peptide is a single chain insulin analog. In one embodiment the insulin peptide is a single chain insulin wherein linking moiety joining the B and A chains comprises an amino acid sequence of no more than 17 amino acids in length and comprising the sequence $GYGSSSX_{57}X_{58}$ (SEQ ID NO: 21), GAGSSSRR (SEQ ID NO: 22) or $GYGSSSX_{57}X_{58}APQT$; (SEQ ID NO: 69) wherein $X_{57}$ and $X_{58}$ are independently arginine, lysine or ornithine and the amino acid designated by $X_{57}$ or $X_{58}$ optionally further comprises a hydrophilic moiety linked to the side chain of the amino acid at that position. In one embodiment the hydrophilic moiety is a polyethylene glycol chain.

Acylation or alkylation can increase the half-life of the glucagon related peptide-insulin conjugate peptides in circulation. Acylation or alkylation can advantageously delay the onset of action and/or extend the duration of action at the insulin receptors. The glucagon related peptide-insulin conjugate peptides may be acylated or alkylated at the same amino acid position where a hydrophilic moiety is linked (including, for example at position 8 of the linking moiety), or at a different amino acid position.

Also encompassed by the present disclosure are pharmaceutical compositions comprising the glucagon related peptide-insulin conjugates and a pharmaceutically acceptable carrier. In accordance with one embodiment a pharmaceutical composition is provided comprising any of the glucagon related peptide-insulin conjugates disclosed herein preferably at a purity level of at least 90%, 91%, 92%, 93%, 94%, 95%, 96%, 97%, 98% or 99%, and a pharmaceutically acceptable diluent, carrier or excipient. Such compositions may contain a single chain insulin agonist peptide as disclosed herein at a concentration of at least 0.5 mg/ml, 1 mg/ml, 2 mg/ml, 3 mg/ml, 4 mg/ml, 5 mg/ml, 6 mg/ml, 7 mg/ml, 8 mg/ml, 9 mg/ml, 10 mg/ml, 11 mg/ml, 12 mg/ml, 13 mg/ml, 14 mg/ml, 15 mg/ml, 16 mg/ml, 17 mg/ml, 18 mg/ml, 19 mg/ml, 20 mg/ml, 21 mg/ml, 22 mg/ml, 23 mg/ml, 24 mg/ml, 25 mg/ml or higher. In one embodiment the pharmaceutical compositions comprise aqueous solutions that are sterilized and optionally stored within various package containers. In other embodiments the pharmaceutical compositions comprise a lyophilized powder. The pharmaceutical compositions can be further packaged as part of a kit that includes a disposable device for administering the composition to a patient. The containers or kits may be labeled for storage at ambient room temperature or at refrigerated temperature.

In accordance with one embodiment an improved method of regulating blood glucose levels in insulin dependent patients is provided. The method comprises the steps of administering to a patient a single chain insulin agonist peptide, or derivative thereof, in an amount therapeutically effective for the control of diabetes.

BRIEF DESCRIPTION OF THE DRAWINGS

FIG. 5 is an alignment of the human proinsulin (A chain, SEQ ID NO: 1; B chain, SEQ ID NO: 2 and the C chain, SEQ ID NO: 141) and insulin-like growth factors I and II (IGF I; SEQ ID NO: 3 and IGF II; SEQ ID NO: 4) amino acid sequences. The alignment demonstrates that these three peptides share a high level of sequence identity (* indicates a space with no corresponding amino acid and a dash (-) indicates the identical amino acid as present in insulin).

FIG. 6 presents the sequence of a set of GLP1 and glucagon fusion peptides formed with a single chain insulin analog. More particularly, the sequences are presented showing a GLP-1-insulin conjugate (GLP1-DP8; SEQ ID NO: 132) and a glucagon-insulin conjugate (Glu-DP8; SEQ ID NO: 135). Further modifications of these two sequences are provided, wherein 1) the tyrosine at position A19 is substituted with alanine to effectively eliminate insulin activity: GLP-Insulin A-chain Ala19 (GLP1-DP8A19; SEQ ID NO: 133) and glucagon-Insulin A-chain Ala19 (Glu-DP8A19; SEQ ID NO: 136)); 2) the phenylalanine at position 22 is substituted with alanine to effectively eliminate GLP-1 activity: GLP1 Ala22 (SEQ ID NO: 134)); 3) the glutamine at position 3 with glutamic acid to eliminate glucagon activity (Glucagon E3; SEQ ID NO: 137); and 4) substitution of the serine at position 16 with glutamic acid to add GLP-1 and glucagon activity (Glucagon E16 (SEQ ID NO: 138)).

FIG. 7 presents the $EC_{50}$ values of chromatographically isolated pool fractions of the synthesized GLP1-DP8 conjugate at the insulin and GLP1 receptors relative to native insulin, IGF-1 and native glucagon. The structure of the GLP1-DP8 conjugate is shown in FIG. 6. Pool 1 demonstrates almost identical activity as native insulin at the insulin receptor. All three pools demonstrated high activity at the GLP1 receptor. Accordingly, the conjugate of pool 1 demonstrates potency as high as native insulin and native GLP1 at their two respective receptors.

FIG. 8 presents the $EC_{50}$ values of chromatographically isolated pool fractions of the synthesized Glu-DP8 conjugate at the insulin, glucagon and GLP1 receptors relative to native insulin, IGF-1 and native glucagon. The structure of the Glu-DP8 conjugate is shown in FIG. 6. Pool 1 demonstrates similar activity as native insulin at the insulin receptor, with the presence of the glucagon sequence moderating the activity of the conjugate at the insulin receptor. Pools 1 and 3 demonstrated high activity at the glucagon receptor. All three pools demonstrate poor activity at the GLP-1 receptor. Accordingly, the conjugate of pool 1 demonstrates high potency at the insulin and glucagon, but retaining selectivity with regard to the GLP1 receptor.

FIG. 10 provides the in vitro activity of GLP1-DP8 and GLP1-DP8A19 (GLP1-DP8 wherein position 19 of the insulin A chain has been modified to alanine) at the insulin receptor. Substitution of alanine at the A19 position effectively eliminates insulin's activity at the insulin receptor. $EC_{50}$ values indicate that both insulin and GLP1-DP8 are potent insulin receptor agonists, whereas GLP-1 and GLP1-DP8A19 have poor activity at the insulin receptor.

FIG. 11 presents the in vitro insulin receptor activity ($EC_{50}$ values) of Glu-DP8 and Glu-DP8A19, a glucagon-insulin conjugate modified to eliminate glucagon activity (GluE3-DP8; wherein position 3 of the glucagon peptide has been modified to glutamic acid), and a modification that maintains activity at the glucagon receptor (GluE16-DP8; wherein position 16 has been modified to glutamic acid). The glutamic acid substitution at position 3 glucagon is known to effectively eliminate glucagon activity. Substitution of alanine at the A19 position of insulin is known to effectively eliminate insulin activity at the insulin receptor. $EC_{50}$ values indicate that both insulin and Glu-DP8 are potent insulin receptor agonists, whereas glucagon and Glu-DP8A19 have poor activity at the insulin receptor. GluE3-DP8 and GluE16-DP8 also showed high potency at the insulin receptor.

FIG. 12 presents the in vitro glucagon receptor activity ($EC_{50}$ values) of Glu-DP8, GluE3-DP8 and GluE16-DP8, Glu-DP8A19, and GLP-1-DP8. The glutamic acid substitution at position 3 of glucagon is known to effectively eliminate glucagon activity, and substitution of alanine at the A19 position of insulin is known to effectively eliminate insulin activity at the insulin receptor. The glutamic acid substitution at position 16 of glucagon produces a co-agonist of glucagon and GLP-1. The $EC_{50}$ values indicate that glucagon, Glu-DP8 and GluE16-DP8 are potent glucagon receptor agonists, whereas GLP-1 and GLP1-DP8, and GluE3-DP8 have poor activity at the glucagon receptor. Accordingly, the conjugates exhibit the expected activities.

FIG. 13 presents the in vitro GLP-1 receptor activity ($EC_{50}$ values) of GLP-1, GLP-1-DP8, GLP-1A22-DP8, GLP-1-DP8A19, Glu-DP8, and GluE16-DP8. GLP-1A22-DP8 represents a conjugate of insulin and GLP-1 wherein position 22 has been substituted with alanine, a modification known to effectively eliminate GLP-1 activity. $EC_{50}$ values indicate that GLP-1, GLP1-DP8 and GLP1-DP8A19 are potent GLP-1 receptor agonists, whereas GLP-1A22-DP8, Glu-DP8, and GluE16-DP8 have poor activity at the GLP-1 receptor. Accordingly, the conjugates exhibit the expected activities.

FIG. 14A-14B present the in vivo effect of the listed conjugates on blood glucose levels in C57BL/6 mice administered DP8 (FIG. 14A) or GLP1-DP8A19 (FIG. 14B) relative to native insulin. DP8 or GLP1-DP8A19 was administered at two concentrations (60 nmoles/kg or 300 nmoles/kg). DP8 successfully lowered blood glucose whereas GLP1-DP8A19 failed to significantly lower blood glucose levels.

DETAILED DESCRIPTION

Definitions

Figure 1:
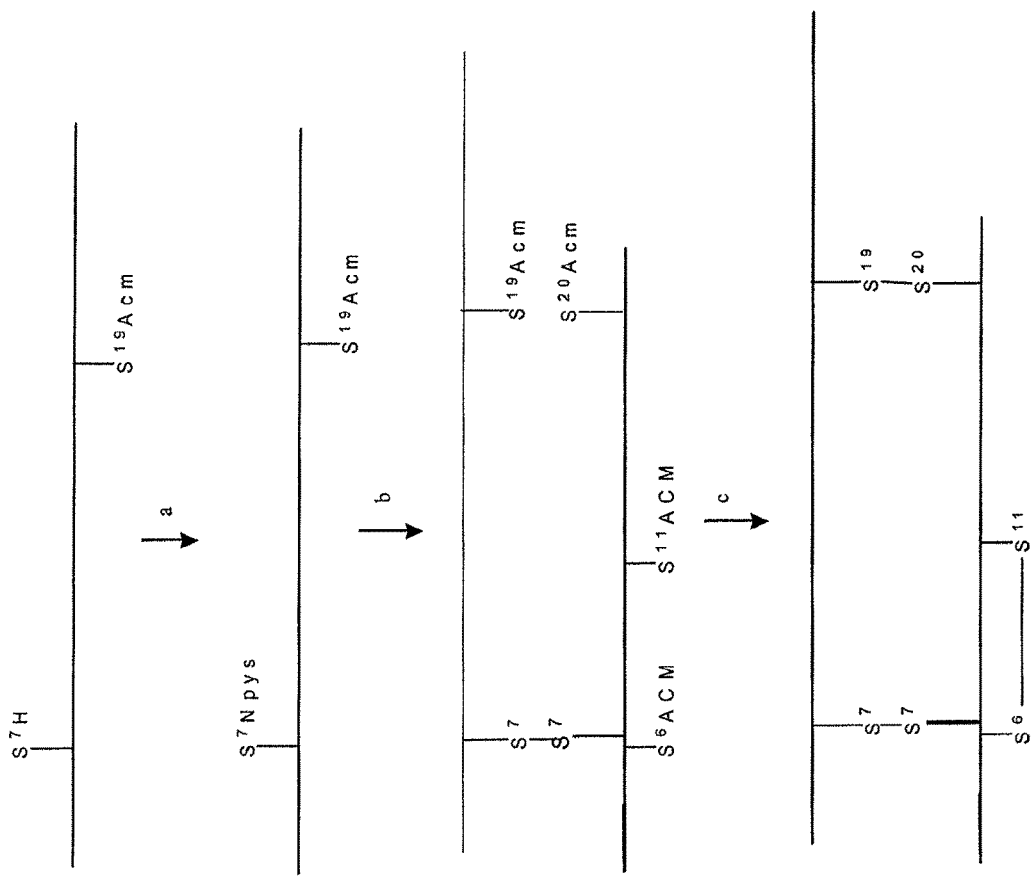
FIG. 1. is a schematic overview of the two step synthetic strategy for preparing human insulin. Details of the procedure are provided in Example 1.

In describing and claiming the invention, the following terminology will be used in accordance with the definitions set forth below.

The term "about" as used herein means greater or lesser than the value or range of values stated by 10 percent, but is not intended to designate any value or range of values to only this broader definition. Each value or range of values preceded by the term "about" is also intended to encompass the embodiment of the stated absolute value or range of values.

As used herein the term "amino acid" encompasses any molecule containing both amino and carboxyl functional groups, wherein the amino and carboxylate groups are attached to the same carbon (the alpha carbon). The alpha carbon optionally may have one or two further organic substituents. For the purposes of the present disclosure designation of an amino acid without specifying its stereochemistry is intended to encompass either the L or D form of the amino acid, or a racemic mixture. However, in the instance where an amino acid is designated by its three letter code and includes a superscript number, the D form of the amino acid is specified by inclusion of a lower case d before the three letter code and superscript number (e.g., $dLys^{-1}$), wherein the designation lacking the lower case d (e.g., $Lys^{-1}$) is intended to specify the native L form of the amino acid. In this nomenclature, the inclusion of the superscript number designates the position of the amino acid in the insulin analog sequence, wherein amino acids that are located within the insulin analog sequence are designated by positive superscript numbers numbered consecutively from the N-terminus. Additional amino acids linked to the insulin analog peptide either at the N-terminus or through a side chain are numbered starting with 0 and increasing in negative integer value as they are further removed from the insulin analog sequence.

As used herein the term "hydroxyl acid" refers to amino acids that have been modified to replace the alpha carbon amino group with a hydroxyl group.

As used herein the term "non-coded amino acid" encompasses any amino acid that is not an L-isomer of any of the following 20 amino acids: Ala, Cys, Asp, Glu, Phe, Gly, His, Ile, Lys, Leu, Met, Asn, Pro, Gln, Arg, Ser, Thr, Val, Trp, Tyr.

A "bioactive polypeptide" refers to polypeptides which are capable of exerting a biological effect in vitro and/or in vivo.

As used herein a general reference to a peptide is intended to encompass peptides that have modified amino and carboxy termini. For example, an amino acid sequence designating the standard amino acids is intended to encompass standard amino acids at the N- and C-terminus as well as a corresponding hydroxyl acid at the N-terminus and/or a corresponding C-terminal amino acid modified to comprise an amide group in place of the terminal carboxylic acid.

As used herein an "acylated" amino acid is an amino acid comprising an acyl group which is non-native to a naturally-occurring amino acid, regardless by the means by which it is produced. Exemplary methods of producing acylated amino acids and acylated peptides are known in the art and include acylating an amino acid before inclusion in the peptide or peptide synthesis followed by chemical acylation of the peptide. In some embodiments, the acyl group causes the peptide to have one or more of (i) a prolonged half-life in circulation, (ii) a delayed onset of action, (iii) an extended duration of action, (iv) an improved resistance to proteases, such as DPP-IV, and (v) increased potency at the IGF and/or insulin peptide receptors.

As used herein, an "alkylated" amino acid is an amino acid comprising an alkyl group which is non-native to a naturally-occurring amino acid, regardless of the means by which it is produced. Exemplary methods of producing alkylated amino acids and alkylated peptides are known in the art and including alkylating an amino acid before inclusion in the peptide or peptide synthesis followed by chemical alkylation of the peptide. Without being held to any particular theory, it is believed that alkylation of peptides will achieve similar, if not the same, effects as acylation of the peptides, e.g., a prolonged half-life in circulation, a delayed onset of action, an extended duration of action, an improved resistance to proteases, such as DPP-IV, and increased potency at the IGF and/or insulin receptors.

As used herein, the term "pharmaceutically acceptable carrier" includes any of the standard pharmaceutical carriers, such as a phosphate buffered saline solution, water, emulsions such as an oil/water or water/oil emulsion, and various types of wetting agents. The term also encompasses any of the agents approved by a regulatory agency of the US Federal government or listed in the US Pharmacopeia for use in animals, including humans.

As used herein the term "pharmaceutically acceptable salt" refers to salts of compounds that retain the biological activity of the parent compound, and which are not biologically or otherwise undesirable. Many of the compounds disclosed herein are capable of forming acid and/or base salts by virtue of the presence of amino and/or carboxyl groups or groups similar thereto.

Pharmaceutically acceptable base addition salts can be prepared from inorganic and organic bases. Salts derived from inorganic bases, include by way of example only, sodium, potassium, lithium, ammonium, calcium and magnesium salts. Salts derived from organic bases include, but are not limited to, salts of primary, secondary and tertiary amines.

Pharmaceutically acceptable acid addition salts may be prepared from inorganic and organic acids. Salts derived from inorganic acids include hydrochloric acid, hydrobromic acid, sulfuric acid, nitric acid, phosphoric acid, and the like. Salts derived from organic acids include acetic acid, propionic acid, glycolic acid, pyruvic acid, oxalic acid, malic acid, malonic acid, succinic acid, maleic acid, fumaric acid, tartaric acid, citric acid, benzoic acid, cinnamic acid, mandelic acid, methanesulfonic acid, ethanesulfonic acid, p-toluene-sulfonic acid, salicylic acid, and the like.

As used herein, the term "hydrophilic moiety" refers to any compound that is readily water-soluble or readily absorbs water, and which are tolerated in vivo by mammalian species without toxic effects (i.e. are biocompatible). Examples of hydrophilic moieties include polyethylene glycol (PEG), polylactic acid, polyglycolic acid, a polylactic-polyglycolic acid copolymer, polyvinyl alcohol, polyvinylpyrrolidone, polymethoxazoline, polyethyloxazoline, polyhydroxyethyl methacrylate, polyhydroxypropyl methacrylamide, polymethacrylamide, polydimethylacrylamide, and derivatised celluloses such as hydroxymethylcellulose or hydroxyethylcellulose and co-polymers thereof, as well as natural polymers including, for example, albumin, heparin and dextran.

As used herein, the term "treating" includes prophylaxis of the specific disorder or condition, or alleviation of the symptoms associated with a specific disorder or condition and/or preventing or eliminating said symptoms. For example, as used herein the term "treating diabetes" will refer in general to maintaining glucose blood levels near normal levels and may include increasing or decreasing blood glucose levels depending on a given situation.

As used herein an "effective" amount or a "therapeutically effective amount" of an insulin analog refers to a nontoxic but sufficient amount of an insulin analog to provide the desired effect. For example one desired effect would be the prevention or treatment of hyperglycemia. The amount that is "effective" will vary from subject to subject, depending on the age and general condition of the individual, mode of administration, and the like. Thus, it is not always possible to specify an exact "effective amount." However, an appropriate "effective" amount in any individual case may be determined by one of ordinary skill in the art using routine experimentation.

The term, "parenteral" means not through the alimentary canal but by some other route such as intranasal, inhalation, subcutaneous, intramuscular, intraspinal, or intravenous.

Throughout the application, all references to a particular amino acid position by letter and number (e.g. position A5) refer to the amino acid at that position of either the A chain (e.g. position A5) or the B chain (e.g. position B5) in the respective native human insulin A chain (SEQ ID NO: 1) or B chain (SEQ ID NO: 2), or the corresponding amino acid position in any analogs thereof. For example, a reference herein to "position B28" absent any further elaboration would mean the corresponding position B27 of the B chain of an insulin analog in which the first amino acid of SEQ ID NO: 2 has been deleted. Similarly, amino acids added to the N-terminus of the native B chain are numbered starting with B0, followed by numbers of increasing negative value (e.g., B-1, B-2 . . . ) as amino acids are added to the N-terminus. Alternatively, any reference to an amino acid position in the linking moiety of a single chain analog, is made in reference to the native C chain of IGF 1 (SEQ ID NO: 17). For example, position 9 of the native C chain (or the "position C9") has an alanine residue.

As used herein the term "native insulin peptide" is intended to designate the 51 amino acid heteroduplex comprising the A chain of SEQ ID NO: 1 and the B chain of SEQ ID NO: 2, as well as single-chain insulin analogs that comprise SEQ ID NOS: 1 and 2. The term "insulin peptide" as used herein, absent further descriptive language is intended to encompass the 51 amino acid heteroduplex comprising the A chain of SEQ ID NO: 1 and the B chain of SEQ ID NO: 2, as well as single-chain insulin analogs thereof (including for example those disclosed in published international application WO96/34882 and U.S. Pat. No. 6,630,348, the disclosures of which are incorporated herein by reference), including heteroduplexes and single-chain analogs that comprise modified analogs of the native A chain and/or B chain and derivatives thereof. Such modified analogs include modification of the amino acid at position A19, B16 or B25 to a 4-amino phenylalanine or one or more amino acid substitutions at positions selected from A5, A8, A9, A10, A12, A14, A15, A17, A18, A21, B1, B2, B3, B4, B5, B9, B10, B13, B14, B17, B20, B21, B22, B23, B26, B27, B28, B29 and B30 or deletions of any or all of positions B1-4 and B26-30. Insulin peptides as defined herein can also be analogs derived from a naturally occurring insulin by insertion or substitution of a non-peptide moiety, e.g. a retroinverso fragment, or incorporation of non-peptide bonds such as an azapeptide bond (CO substituted by NH) or pseudo-peptide bond (e.g. NH substituted with $CH_2$) or an ester bond (e.g., a depsipeptide, wherein one or more of the amide (—CONHR—) bonds are replaced by ester (COOR) bonds).

An "A19 insulin analog" is an insulin peptide that has a substitution of 4-amino phenylalanine or 4-methoxy phenylalanine for the native tyrosine residue at position 19 of the A chain of native insulin.

As used herein an "$IGF^{B16B17}$ analog peptide" is a generic term that comprising an A chain and B chain heteroduplex, as well as single-chain insulin analogs thereof, wherein the A chain comprises the peptide sequence of SEQ ID NO: 19 and the B chain comprises the sequence of SEQ ID NO: 20 as well as analogs of those sequences wherein the analog of the A chain and/or B chain comprise 1-3 further amino acid substitutions, with the proviso that the B chain does not comprise the sequence of SEQ ID NO: 2 and comprises a tyrosine at position B16 and a leucine at position B17.

An "IGF YL analog" is a peptide comprising an IGF A chain of SEQ ID NO: 19 and an IGF B chain of SEQ ID NO: 36.

As used herein, the term "single-chain insulin analog" encompasses a group of structurally-related proteins wherein insulin or IGF A and B chains, or analogs or derivatives thereof, are covalently linked to one another to form a linear polypeptide chain. As disclosed herein the single-chain insulin analog comprises the covalent linkage of the carboxy terminus of the B chain to the amino terminus of the A chain via a linking moiety.

As used herein the term "insulin A chain", absent further descriptive language is intended to encompass the 21 amino acid sequence of SEQ ID NO: 1 as well as functional analogs and derivatives thereof, including the A chain of A19 insulin analogs and other analogs known to those skilled in the art, including modification of the sequence of SEQ ID NO: 1 by one or more amino acid insertions, deletions or substitutions at positions selected from A4, A5, A8, A9, A10, A12, A14, A15, A17, A18, A21.

As used herein the term "insulin B chain", absent further descriptive language is intended to encompass the 30 amino acid sequence of SEQ ID NO: 2, as well as modified functional analogs of the native B chain, including modification of the amino acid at position B16 or B25 to a 4-amino phenylalanine or one or more amino acid insertions, deletions or substitutions at positions selected from B1, B2, B3, B4, B5, B9, B10, B13, B14, B17, B20, B21, B22, B23, B25, B26, B27, B28, B29 and B30 or deletions of any or all of positions B1-4 and B26-30.

The term "identity" as used herein relates to the similarity between two or more sequences. Identity is measured by dividing the number of identical residues by the total number of residues and multiplying the product by 100 to achieve a percentage. Thus, two copies of exactly the same sequence have 100% identity, whereas two sequences that have amino acid deletions, additions, or substitutions relative to one another have a lower degree of identity. Those skilled in the art will recognize that several computer programs, such as those that employ algorithms such as BLAST (Basic Local Alignment Search Tool, Altschul et al. (1993) J. Mol. Biol. 215:403-410) are available for determining sequence identity.

The term "glucagon related peptide" refers to those peptides which have biological activity (as agonists or antagonists) at any one or more of the glucagon, GLP-1, GLP-2, and GIP receptors and comprise an amino acid sequence that shares at least 40% sequence identity (e.g., 45%, 50%, 55%, 60%, 65%, 70%, 75%, 80%, 85%, 90%, 95%) with at least one of native glucagon, native oxyntomodulin, native exendin-4, native GLP-1, native GLP-2, or native GIP. Unless otherwise stated, any reference to an amino acid position in a glucagon related peptide (e.g. for linkage of a prodrug moiety, a conjugate moiety, a hydrophilic polymer, acylation or alkylation) refers to the position relative to the native glucagon amino acid sequence (SEQ ID NO: 701).

As used herein reference to the C-terminal region of a glucagon related peptide is intended to encompass the native C-terminus of a glucagon peptide or any amino acid of a C-terminal extension of a glucagon analog that has been extended by the addition of one or more amino acids at the C-terminus, or the terminal amino acid of a glucagon analog that has been shortened by the deletion of one or more amino acids, respectively, relative to the native glucagon sequence. An insulin peptide conjugated at the C-terminal region of a glucagon related peptide is intended to include linkage to the side chain of an amino acid of the C-terminal region or linkage through the C-terminal carboxylic acid moiety.

The term "GLP-1 agonist" refers to a compound that stimulates GLP-1 receptor activity, as measured by cAMP production using a validated in vitro model assay, such as that described in Example 13 of published International Application No. WO 2007/056362, published on May 18, 2007, the disclosure of which is hereby expressly incorporated by reference into the present application.

As used herein the term "native glucagon" refers to a peptide consisting of the sequence of SEQ ID NO: 701, the term "native GIP" refers to a peptide consisting of the sequence of SEQ ID NO: 707, and the term "native GLP-1" is a generic term that designates GLP-1(7-36) amide (consisting of the sequence of SEQ ID NO: 703), GLP-1(7-37) acid (consisting of the sequence of SEQ ID NO: 704) or a mixture of those two compounds. As used herein, a general reference to "glucagon" or "GIP" or "GLP-1" in the absence of any further designation is intended to mean native glucagon or native GIP or native GLP-1, respectively.

As used herein the term "glucagon peptide" is a generic term that designates the natural glucagon peptide of SEQ ID NO: 701 as well as modified derivatives having one or more amino acid modifications relative to the native glucagon sequence, optionally including but not limited to substitutions at amino acid positions 1, 2, 5, 7, 8, 10, 12, 13, 14, 16, 17, 18, 24, 28 and 29. Generally, all references to a particular amino acid position by number (e.g. position 28) refer to the amino acid at that position in native glucagon (SEQ ID NO: 701) or the corresponding amino acid position in any analogs thereof. For example, a reference to "position 28" would mean the corresponding position 27 for a glucagon analog in which the first amino acid of SEQ ID NO: 701 has been deleted. Similarly, a reference to "position 28" would mean the corresponding position 29 for a glucagon analog in which one amino acid has been added before the N-terminus of SEQ ID NO: 701.

As used herein the term "GLP-1 peptide" is a generic term that designates native GLP-1 as well as modified derivatives having one or more amino acid modifications relative to the native GLP-1 sequence.

As used herein the term "derivative" is intended to encompass chemical modification to a compound (e.g., an amino acid), including chemical modification in vitro, e.g. by introducing a group in a side chain in one or more positions of a polypeptide, e.g. a nitro group in a tyrosine residue, or iodine in a tyrosine residue, or by conversion of a free carboxylic group to an ester group or to an amide group, or by converting an amino group to an amide by acylation, or by acylating a hydroxy group rendering an ester, or by alkylation of a primary amine rendering a secondary amine or linkage of a hydrophilic moiety to an amino acid side chain. Other derivatives are obtained by oxidation or reduction of the side-chains of the amino acid residues in the polypeptide.

As used herein the term IGF A chain, absent further descriptive language is intended to encompass the 21 amino acid sequence of native IGF 1 or IGF 2 (SEQ ID NOs: 5 and 7 respectively), as well as functional analogs thereof known to those skilled in the art, including modification of the sequence of SEQ ID NO: 5 and 7 by one or more amino acid substitutions at positions selected from A5, A8, A9, A10, A12, A14, A15, A17, A18, A21.

As used herein the term "IGF YL B chain", absent further descriptive language is intended to encompass an amino acid sequence comprising SEQ ID NO: 20, as well as analogs of the IGF YL B chain and derivatives thereof, including modification of the amino acid at position B16 or B25 to a 4-amino phenylalanine or one or more amino acid substitutions at positions selected from B1, B2, B3, B4, B5, B9, B10, B13, B14, B17, B20, B21, B22, B23, B26, B27, B28, B29 and B30 or deletions of any or all of positions B1-4 and B26-30.

As used herein, the term "selectivity" of a molecule for a first receptor relative to a second receptor refers to the following ratio: $EC_{50}$ of the molecule at the second receptor divided by the $EC_{50}$ of the molecule at the first receptor. For example, a molecule that has an $EC_{50}$ of 1 nM at a first receptor and an $EC_{50}$ of 100 nM at a second receptor has 100-fold selectivity for the first receptor relative to the second receptor.

As used herein an amino acid "modification" refers to a substitution of an amino acid, or the derivation of an amino acid by the addition and/or removal of chemical groups to/from the amino acid, and includes substitution with any of the 20 amino acids commonly found in human proteins, as well as atypical or non-naturally occurring amino acids. Commercial sources of atypical amino acids include Sigma-Aldrich (Milwaukee, Wis.), ChemPep Inc. (Miami, Fla.), and Genzyme Pharmaceuticals (Cambridge, Mass.). Atypical amino acids may be purchased from commercial suppliers, synthesized de novo, or chemically modified or derivatized from naturally occurring amino acids.

As used herein an amino acid "substitution" refers to the replacement of one amino acid residue by a different amino acid residue.

As used herein, the term "conservative amino acid substitution" is defined herein as exchanges within one of the following five groups:

I. Small aliphatic, nonpolar or slightly polar residues:
Ala, Ser, Thr, Pro, Gly;
II. Polar, negatively charged residues and their amides:
Asp, Asn, Glu, Gln, cysteic acid and homocysteic acid;
III. Polar, positively charged residues:
His, Arg, Lys; Ornithine (Orn)
IV. Large, aliphatic, nonpolar residues:
Met, Leu, Ile, Val, Cys, Norleucine (Nle), homocysteine
V. Large, aromatic residues:
Phe, Tyr, Trp, acetyl phenylalanine As used herein the general term "polyethylene glycol chain" or "PEG chain", refers to mixtures of condensation polymers of ethylene oxide and water, in a branched or straight chain, represented by the general formula $H(OCH_2CH_2)_nOH$, wherein n is at least 2. "Polyethylene glycol chain" or "PEG chain" is used in combination with a numeric suffix to indicate the approximate average molecular weight thereof. For example, PEG-5,000 refers to polyethylene glycol chain having a total molecular weight average of about 5,000 Daltons.

As used herein the term "pegylated" and like terms refers to a compound that has been modified from its native state by linking a polyethylene glycol chain to the compound. A "pegylated polypeptide" is a polypeptide that has a PEG chain covalently bound to the polypeptide.

As used herein a "linker" is a bond, molecule or group of molecules that binds two separate entities to one another. Linkers may provide for optimal spacing of the two entities or may further supply a labile linkage that allows the two entities to be separated from each other. Labile linkages include photocleavable groups, acid-labile moieties, base-labile moieties and enzyme-cleavable groups.

As used herein a "dimer" is a complex comprising two subunits covalently bound to one another via a linker. The term dimer, when used absent any qualifying language, encompasses both homodimers and heterodimers. A homodimer comprises two identical subunits, whereas a heterodimer comprises two subunits that differ, although the two subunits are substantially similar to one another.

The term "$C_1$-$C_n$ alkyl" wherein n can be from 1 through 6, as used herein, represents a branched or linear alkyl group having from one to the specified number of carbon atoms. Typical $C_1$-$C_6$ alkyl groups include, but are not limited to, methyl, ethyl, n-propyl, iso-propyl, butyl, iso-Butyl, sec-butyl, tert-butyl, pentyl, hexyl and the like.

The terms "$C_2$-$C_n$ alkenyl" wherein n can be from 2 through 6, as used herein, represents an olefinically unsaturated branched or linear group having from 2 to the specified number of carbon atoms and at least one double bond. Examples of such groups include, but are not limited to, 1-propenyl, 2-propenyl (—$CH_2$—CH=$CH_2$), 1,3-butadienyl, (—CH=CHCH=$CH_2$), 1-butenyl (—CH=CHCH$_2$CH$_3$), hexenyl, pentenyl, and the like.

The term "$C_2$-$C_n$ alkynyl" wherein n can be from 2 to 6, refers to an unsaturated branched or linear group having from 2 to n carbon atoms and at least one triple bond. Examples of such groups include, but are not limited to, 1-propynyl, 2-propynyl, 1-butynyl, 2-butynyl, 1-pentynyl, and the like.

As used herein the term "aryl" refers to a mono- or bicyclic carbocyclic ring system having one or two aromatic rings including, but not limited to, phenyl, naphthyl, tetrahydronaphthyl, indanyl, indenyl, and the like. The size of the aryl ring and the presence of substituents or linking groups are indicated by designating the number of carbons present. For example, the term "($C_1$-$C_3$ alkyl)($C_6$-$C_{10}$ aryl)" refers to a 5 to 10 membered aryl that is attached to a parent moiety via a one to three membered alkyl chain.

The term "heteroaryl" as used herein refers to a mono- or bi-cyclic ring system containing one or two aromatic rings and containing at least one nitrogen, oxygen, or sulfur atom in an aromatic ring. The size of the heteroaryl ring and the presence of substituents or linking groups are indicated by designating the number of carbons present. For example, the term "($C_1$-$C_n$ alkyl)($C_5$-$C_6$ heteroaryl)" refers to a 5 or 6 membered heteroaryl that is attached to a parent moiety via a one to "n" membered alkyl chain.

As used herein, the term "halo" refers to one or more members of the group consisting of fluorine, chlorine, bromine, and iodine.

As used herein the term "patient" without further designation is intended to encompass any warm blooded vertebrate domesticated animal (including for example, but not limited to livestock, horses, cats, dogs and other pets) and humans.

The term "isolated" as used herein means having been removed from its natural environment. In some embodiments, the analog is made through recombinant methods and the analog is isolated from the host cell.

The term "purified," as used herein relates to the isolation of a molecule or compound in a form that is substantially free of contaminants normally associated with the molecule or compound in a native or natural environment and means having been increased in purity as a result of being separated from other components of the original composition. The term "purified polypeptide" is used herein to describe a polypeptide which has been separated from other compounds including, but not limited to nucleic acid molecules, lipids and carbohydrates.

A "peptidomimetic" refers to a chemical compound having a structure that is different from the general structure of an existing peptide, but that functions in a manner similar to the existing peptide, e.g., by mimicking the biological activity of that peptide. Peptidomimetics typically comprise naturally-occurring amino acids and/or unnatural amino acids, but can also comprise modifications to the peptide backbone. For example a peptidomimetic may include a sequence of naturally-occurring amino acids with the insertion or substitution of a non-peptide moiety, e.g. a retroinverso fragment, or incorporation of non-peptide bonds such as an azapeptide bond (CO substituted by NH) or pseudo-peptide bond (e.g. NH substituted with CH2), or an ester bond (e.g., depsipeptides, wherein one or more of the amide (—CONHR—) bonds are replaced by ester (COOR) bonds). Alternatively the peptidomimetic may be devoid of any naturally-occurring amino acids.

As used herein the term "charged amino acid" or "charged residue" refers to an amino acid that comprises a side chain that is negatively charged (i.e., de-protonated) or positively charged (i.e., protonated) in aqueous solution at physiological pH. For example, negatively charged amino acids include aspartic acid, glutamic acid, cysteic acid, homocysteic acid, and homoglutamic acid, whereas positively charged amino acids include arginine, lysine and histidine. Charged amino acids include the charged amino acids among the 20 amino acids commonly found in human proteins, as well as atypical or non-naturally occurring amino acids.

As used herein the term "acidic amino acid" refers to an amino acid that comprises a second acidic moiety (other than the alpha carboxylic acid of the amino acid), including for example, a side chain carboxylic acid or sulfonic acid group.

As used herein the term "patient" without further designation is intended to encompass any warm blooded vertebrate domesticated animal (including for example, but not limited to livestock, horses, cats, dogs and other pets), mammals, and humans.

Abbreviations

Insulin analogs will be abbreviated as follows:
The insulin A and B chains will be designated by a capital A for the A chain and a capital B for the B chain wherein a superscript 0 (e.g., $A^0$ or $B^0$) will designate the base sequence is an insulin sequence (A chain: SEQ ID NO: 1, B chain SEQ ID NO: 2) and a superscript 1 (e.g., $A^1$ or $B^1$) will designate the base sequence is an IGF-1 sequence (A chain: SEQ ID NO: 5, B chain SEQ ID NO: 6). Modifications that deviate from the native insulin and IGF sequence are indicated in parenthesis following the designation of the A or B chain (e.g., [$B^1$(H5,H10,Y16,L17):$A^1$(H8,N18,N21)]) with the single letter amino acid abbreviation indicating the substitution and the number indicating the position of the substitution in the respective A or B chain, using native insulin numbering. A colon between the A and B chain indicates a two chain insulin whereas a dash will indicate a covalent bond and thus a single chain analog. In single chain analogs a linking moiety will be included between the A and B chains and the designation C refers to the native IGF 1 C peptide, SEQ ID NO: 17. The designation "position C8" in reference to the linking moiety designates an amino acid located at the position corresponding to the eighth amino acid of SEQ ID NO: 17.

EMBODIMENTS

Disclosed herein are conjugates of an insulin peptide and a glucagon related peptide. In one embodiment the conjugate comprises a covalent linkage of the insulin peptide and the glucagon related peptide either directly or through a linker. In one embodiment the glucagon related peptide is covalently linked to the amino or carboxy terminus of the insulin A chain or B chain. In another embodiment the C-terminal region of one or two glucagon related peptides are covalently linked to the insulin peptide through a position independently selected from the side chain of an amino acid at a position selected from the group consisting of A9, A14 and A15 of the A chain, positions B1, B2, B10, B22, B28 or B29 of the B chain, at the N-terminal alpha amine of the A or B chain, the carboxy terminus of the B chain or at the side chain of an amino acid at any position of a linking moiety that links the A chain and B chain in a single chain insulin analog, including for example at position C8. In another embodiment the N-terminus or C-terminus of an insulin peptide is covalently linked to the side chain of an amino acid of the glucagon related peptide at a position selected from 10, 20, 24, 28 and 29.

In another embodiment one or two glucagon related peptides are covalently linked to the insulin peptide through a position independently selected from the N-terminal alpha amine of the B chain, the carboxy terminus of the B chain or at any position of the linking moiety that links the A chain and B chain of a single chain insulin analog, including for example at position C8. In one embodiment the carboxy terminal region of the glucagon related peptide is covalently linked to the N-terminal alpha amine of the B chain of a single chain insulin peptide analog. In one embodiment the carboxy terminus of the glucagon related peptide is covalently linked to the N-terminal alpha amine of the B chain of a two chain or single chain insulin peptide analog.

In accordance with one embodiment the insulin peptide is a two chain insulin, wherein the A chain and B chain are linked to one another via interchain disulfide bonds. In one embodiment the conjugate comprises a two chain insulin peptide wherein the carboxy terminal region of the glucagon related peptide is covalently linked to the amino terminus of the A chain of the insulin peptide. In one embodiment the conjugate comprises a two chain insulin peptide wherein the carboxy terminus of the A chain or the B chain of the insulin peptide is covalently linked to the amino terminus of the glucagon related peptide. In one embodiment the conjugate comprises a two chain insulin peptide wherein the carboxy terminus of the glucagon related peptide is covalently linked to the amino terminus of the B chain of the insulin peptide. In one embodiment the conjugate comprises a two chain insulin peptide wherein the carboxy terminus of the B chain of the insulin peptide is covalently linked to the amino terminus of the glucagon related peptide.

In another embodiment the conjugate comprises a two chain insulin analog and a first and second glucagon related peptide wherein each glucagon related peptide is independently covalently linked to the insulin peptide at a position selected from the group consisting of the amino terminus of the B chain, the carboxy terminus of the A chain, and the carboxy terminus of the B chain. In one embodiment the conjugate comprises a two chain insulin peptide wherein the carboxy terminal region of a first glucagon related peptide is covalently linked to the amino terminus of the B chain of the insulin peptide and the carboxy terminus of the B chain of the insulin peptide is covalently linked to the amino terminus of a second glucagon related peptide. In one embodiment the first and second glucagon related peptides are different and have activity at two different receptors selected from the group consisting of the glucagon, GLP-1 and GIP receptors. In one embodiment the first glucagon related peptide has activity at the glucagon receptor and the second glucagon related peptide has activity at the GLP-1 receptor. In one embodiment the first and/or second glucagon related peptide is a coagonist having activity at two receptors selected from the group consisting of the glucagon, GLP-1 and GIP receptors.

In one embodiment the conjugate represents a fusion protein wherein the carboxy terminal region of the glucagon related peptide is linked to the amino terminus of the insulin peptide B chain either directly or through a peptide linker. In one embodiment the conjugate comprises a single chain insulin analog wherein the carboxy terminal region of the glucagon related peptide is covalently linked to the amino terminus of the single chain insulin analog. In one embodiment the conjugate comprises a single chain insulin analog wherein the carboxy terminus of the single chain insulin peptide is covalently linked to the amino terminus of the glucagon related peptide.

In some or any embodiments, the insulin peptide of the presently disclosed conjugate is native insulin, comprising the A chain of SEQ ID NO: 1 and the B chain of SEQ ID NO: 2, or an analog of native insulin, including for example a single-chain insulin analog comprising SEQ ID NOS: 1 and 2. In one embodiment the insulin peptide is an $IGF^{B16B17}$ analog peptide. In accordance with the present disclosure analogs of insulin encompass polypeptides comprising an A chain and a B chain wherein the insulin analogs differ from native insulin by one or more amino acid substitutions at positions selected from A5, A8, A9, A10, A12, A14, A15, A17, A18, A21, B1, B2, B3, B4, B5, B9, B10, B13, B14, B17, B20, B21, B22, B23, B26, B27, B28, B29 and B30 or deletions of any or all of positions B1-4 and B26-30.

In one embodiment the glucagon related peptide component of the conjugate is a peptide selected from the group consisting of native glucagon (SEQ ID NO: 701), native GLP-1 (SEQ ID NO: 703) and native GIP (SEQ ID NO: 707). In one embodiment the glucagon related peptide is a glucagon peptide or GLP-1 peptide. In some embodiments, the glucagon related peptide of the conjugate of the present disclosures is an analog of native human glucagon (SEQ ID NO: 701) comprising an amino acid sequence based on the amino acid sequence of SEQ ID NO: 701 but differing from SEQ ID NO: 701 inasmuch as the amino acid sequence of the glucagon analog comprises one or more (e.g., 1, 2, 3, 4, 5, 6, 7, 8, 9, 10, 11, 12, 13, 14, 15, and in some instances, 16 or more (e.g., 17, 18, 19, 20, 21, 22, 23, 24, 25, etc.), specified or optional amino acid modifications. In some or any embodiments, the peptide of the present disclosures comprises a total of 1, up to 2, up to 3, up to 4, up to 5, up to 6, up to 7, up to 8, up to 9, or up to 10 additional amino acid modifications (e.g., in addition to the specified amino acid modifications), relative to the native human glucagon sequence (SEQ ID NO: 701). For example, in one embodiment an analog of glucagon (SEQ ID NO: 701) comprises (a) an amino acid comprising an imidazole side chain at position 1, (b) a DPP-IV protective amino acid at position 2, (c) an acylated amino acid or alkylated amino acid at any of positions 9, 10, 12, 16, 20, or 37-43, (d) an alpha helix stabilizing amino acid at one or more of positions 16, 17, 18, 19, 20, and 21, and (e) up to ten additional amino acid modifications relative to SEQ ID NO: 701. In one embodiment the present disclosure provides an analog of glucagon comprising (a)-(d) with up to 10 additional amino acid modifications in addition to the amino acid modifications specified in (a)-(d). In some or any embodiments, the modifications are any of those described herein, e.g., acylation, alkylation, pegylation, truncation at C-terminus, substitution of the amino acid at one or more of positions 1, 2, 3, 7, 10, 12, 15, 16, 17, 18, 19, 20, 21, 23, 24, 27, 28, and 29.

Insulin Peptides

The insulin peptide component of the conjugates of the present disclosure may comprise the native B and A chain sequences of human insulin (SEQ ID NOs: 1 and 2, respectively) or any of the known analogs or derivatives thereof that exhibit insulin agonist activity when linked to one another in a heteroduplex. Such analogs include, for example, proteins having an A-chain and a B-chain that differ from the A-chain and B-chain of human insulin by having one or more amino acid deletions, one or more amino acid substitutions, and/or one or more amino acid insertions that do not destroy the insulin activity of the insulin analog.

In one embodiment the insulin peptide is an insulin analog wherein:

(a) the amino acid residue at position B28 is substituted with Asp, Lys, Leu, Val, or Ala, and the amino acyl residue at position B29 is Lys or Pro;

(b) the amino acid residues at any of positions B27, B28, B29, and B30 are deleted or substituted with a nonnative amino acid. In one embodiment an insulin analog is provided comprising an Asp substituted at position B28 or a Lys substituted at position 28 and a proline substituted at position B29. Additional insulin analogs are disclosed in Chance, et al., U.S. Pat. No. 5,514,646; Chance, et al., U.S. patent application Ser. No. 08/255,297; Brems, et al., Protein Engineering, 5:527-533 (1992); Brange, et al., EPO Publication No. 214,826 (published Mar. 18, 1987); and Brange, et al., Current Opinion in Structural Biology, 1:934-940 (1991). The disclosures of which are expressly incorporated herein by reference.

Insulin analogs may also have replacements of the amidated amino acids with acidic forms. For example, Asn may be replaced with Asp or Glu. Likewise, Gln may be replaced with Asp or Glu. In particular, Asn(A18), Asn(A21), or Asp(B3), or any combination of those residues, may be replaced by Asp or Glu. Also, Gln(A15) or Gln(B4), or both, may be replaced by either Asp or Glu.

As disclosed herein single chain insulin agonists are provided comprising a B chain and an A chain of human insulin, or analogs or derivative thereof, wherein the carboxy terminus of the B chain is linked to the amino terminus of the A chain via a linking moiety. In one embodiment the A chain is an amino acid sequence selected from the group consisting of GIVEQCCTSICSLYQLENYCN (SEQ ID NO: 1), GIVDECCFRSCDLRRLEMYCA (SEQ ID NO: 5) or GIVEECCFRSCDLALLETYCA (SEQ ID NO: 7) and the B chain comprises the sequence FVNQHLCG-SHLVEALYLVCGERGFFYTPKT (SEQ ID NO: 2), GPETLCGAELVDALYLVCGDRGFYFNKPT (SEQ ID NO: 6) or AYRPSETLCGGELVDTLYLVCGDRGFYF-SRPA (SEQ ID NO: 8), or a carboxy shortened sequence thereof having one to five amino acids corresponding to B26, B27, B28, B29 and B30 deleted, and analogs of those sequences wherein each sequence is modified to comprise one to five amino acid substitutions at positions corresponding to native insulin positions (see peptide alignment shown in FIG. 5) selected from A5, A8, A9, A10, A14, A15, A17, A18, A21, B1, B2, B3, B4, B5, B9, B10, B13, B14, B20, B22, B23, B26, B27, B28, B29 and B30. In one embodiment the amino acid substitutions are conservative amino acid substitutions. Suitable amino acid substitutions at these positions that do not adversely impact insulin's desired activities are known to those skilled in the art, as demonstrated, for example, in Mayer, et al., Insulin Structure and Function, Biopolymers. 2007; 88(5):687-713, the disclosure of which is incorporated herein by reference.

Additional amino acid sequences can be added to the amino terminus of the B chain or to the carboxy terminus of the A chain of the single chain insulin agonists of the present invention. For example, a series of negatively charged amino acids can be added to the amino terminus of the B chain, including for example a peptide of 1 to 12, 1 to 10, 1 to 8 or 1 to 6 amino acids in length and comprising one or more negatively charged amino acids including for example glutamic acid and aspartic acid. In one embodiment the B chain amino terminal extension comprises 1 to 6 charged amino acids. In one embodiment the B chain amino terminal extension comprises the sequence $GX_{61}X_{62}X_{63}X_{64}X_{65}K$ (SEQ ID NO: 26) or $X_{61}X_{62}X_{63}X_{64}X_{65}RK$ (SEQ ID NO: 27), wherein $X_{61}$, $X_{62}$, $X_{63}$ $X_{64}$ and $X_{65}$ are independently glutamic acid or aspartic acid. In one embodiment the B chain comprises the sequence GEEEEEKGPE-HLCGAHLVDALYLVCGDX$_{42}$GFY (SEQ ID NO: 28), wherein $X_{42}$ is selected from the group consisting of alanine, lysine, ornithine and arginine. In accordance with one embodiment the glucagon related peptide-insulin conjugates disclosed herein comprise a C-terminal amide or ester in place of a C-terminal carboxylate on the A chain.

High potency glucagon related peptide-insulin conjugates can also be prepared based on using a modified IGF I and IGF II sequence described in published International application no. WO 2010/080607, the disclosure of which is expressly incorporated herein by reference, as the insulin peptide component. More particularly, analogs of IGF I and IGF II that comprise a substitution of a tyrosine leucine dipeptide for the native IGF amino acids at positions corresponding to B16 and B17 of native insulin have a tenfold increase in potency at the insulin receptor.

In accordance with one embodiment the insulin peptide for use in the present disclosure comprises a B chain sequence of $R_{22}$-$X_{25}$LCG$X_{29}X_{30}$LV$X_{33}$ $X_{34}$LYL VCG$X_{41}X_{42}$GF$X_{45}$ (SEQ ID NO: 20) and an A chain sequence of GIV$X_4X_5$CC$X_8X_9X_{10}$C$X_{12}$L$X_{14}X_{15}$ L$X_{17}X_{18}$ $X_{19}$C$X_{21}$-$R_{13}$ (SEQ ID NO: 29) wherein $X_4$ is glutamic acid or aspartic acid;

$X_5$ is glutamine or glutamic acid $X_8$ is histidine, threonine or phenylalanine;

$X_9$ is serine, arginine, lysine, ornithine or alanine;

$X_{10}$ is isoleucine or serine;

$X_{12}$ is serine or aspartic acid $X_{14}$ is tyrosine, arginine, lysine, ornithine or alanine;

$X_{15}$ is glutamine, glutamic acid, arginine, alanine, lysine, ornithine or leucine;

$X_{17}$ is glutamine, glutamic acid, arginine, aspartic acid or lysine, ornithine $X_{18}$ is methionine, asparagine, glutamine, aspartic acid, glutamic acid or threonine;

$X_{19}$ is tyrosine, 4-methoxy-phenylalanine or 4-amino phenylalanine;

$X_{21}$ is selected from the group consisting of alanine, glycine, serine, valine, threonine, isoleucine, leucine, glutamine, glutamic acid, asparagine, aspartic acid, histidine, tryptophan, tyrosine, and methionine;

$X_{25}$ is histidine or threonine;

$X_{29}$ is selected from the group consisting of alanine, glycine and serine;

$X_{30}$ is selected from the group consisting of histidine, aspartic acid, glutamic acid, homocysteic acid and cysteic acid;

$X_{33}$ is selected from the group consisting of aspartic acid, glutamine and glutamic acid;

$X_{34}$ is selected from the group consisting of alanine and threonine;

$X_{41}$ is selected from the group consisting of glutamic acid, aspartic acid or asparagine;

$X_{42}$ is selected from the group consisting of alanine, lysine, ornithine and arginine;

$X_{45}$ is tyrosine, histidine, asparagine or phenylalanine;

$R_{22}$ is selected from the group consisting of AYRPSE (SEQ ID NO: 14), FVNQ (SEQ ID NO: 12), PGPE (SEQ ID NO: 11), a tripeptide glycine-proline-glutamic acid, a tripeptide valine-asparagine-glutamine, a dipeptide proline-glutamic acid, a dipeptide asparagine-glutamine, glutamine, glutamic acid and a bond; and $R_{13}$ is COOH or $CONH_2$. In one embodiment the A chain and the B chain are linked to one another by interchain disulfide bonds, including those that form between the A and B chains of native insulin. In an alternative embodiment the A and B chains are linked together as a linear single chain-insulin peptide.

In one embodiment the conjugates comprise an insulin peptide wherein the A chain comprises a sequence of $GIVEQCCX_1SICSLYQLENX_2CX_3$ (SEQ ID NO: 30) and said B chain sequence comprises a sequence of $X_4LCGX_5X_6LVEALYLVCGERGFF$ (SEQ ID NO: 31), wherein $X_1$ is selected from the group consisting of threonine and histidine;

$X_2$ is tyrosine, 4-methoxy-phenylalanine or 4-amino phenylalanine;

$X_3$ is selected from the group consisting of asparagine and glycine;

$X_4$ is selected from the group consisting of histidine and threonine;

$X_5$ is selected from the group consisting of alanine, glycine and serine;

$X_6$ is selected from the group consisting of histidine, aspartic acid, glutamic acid, homocysteic acid and cysteic acid.

In accordance with one embodiment an insulin analog is provided wherein the A chain of the insulin peptide comprises the sequence $GIVEQCCX_8X_9ICSLYQLENYCX_{21}$-$R_{13}$ (SEQ ID NO: 73) or $GIVEQCCX_8SICSLYQLX_{17}NX_{19}CX_{21}$ (SEQ ID NO: 32) and the B chain comprising the sequence $R_{22}$-$X_{25}LCGX_{29}X_{30}LVX_{33}X_{34}LYLVCGX_{41}X_{42}GFX_{45}YT$-$Z_1$-$B_1$ (SEQ ID NO: 142), wherein $X_8$ is selected from the group consisting of threonine and histidine;

$X_9$ is valine or tyrosine;

$X_{17}$ is glutamine or glutamic acid;

$X_{19}$ is tyrosine, 4-methoxy phenylalanine or 4-amino-phenylalanine;

$X_{21}$ is asparagine or glycine;

$X_{25}$ is histidine or threonine;

$X_{29}$ is selected from the group consisting of alanine, glycine and serine;

$X_{30}$ is selected from the group consisting of histidine, aspartic acid, glutamic acid, homocysteic acid and cysteic acid;

$X_{33}$ is selected from the group consisting of aspartic acid and glutamic acid;

$X_{34}$ is selected from the group consisting of alanine and threonine;

$X_{41}$ is selected from the group consisting of glutamic acid, aspartic acid or asparagine;

$X_{42}$ is selected from the group consisting of alanine, ornithine, lysine and arginine;

$X_{45}$ is tyrosine or phenylalanine;

$R_{22}$ is selected from the group consisting of FVNQ (SEQ ID NO: 12), a tripeptide valine-asparagine-glutamine, a dipeptide asparagine-glutamine, glutamine and an N-terminal amine $Z_1$ is a dipeptide selected from the group consisting of aspartate-lysine, lysine-proline, and proline-lysine; and $B_1$ is selected from the group consisting of threonine, alanine or a threonine-arginine-arginine tripeptide.

In accordance with one embodiment an insulin analog is provided wherein the A chain of the insulin peptide comprises the sequence $GIVEQCCX_8SICSLYQLX_{17}NX_{19}CX_{21}$ (SEQ ID NO: 32) and the B chain comprising the sequence $X_{25}LCGX_{29}X_{30}LVEALYLVCGERGFF$ (SEQ ID NO: 33) wherein $X_8$ is selected from the group consisting of threonine and histidine;

$X_{17}$ is glutamic acid or glutamine;

$X_{19}$ is tyrosine, 4-methoxy-phenylalanine or 4-amino phenylalanine;

$X_{21}$ is asparagine or glycine;

$X_{25}$ is selected from the group consisting of histidine and threonine;

$X_{29}$ is selected from the group consisting of alanine, glycine and serine;

$X_{30}$ is selected from the group consisting of histidine, aspartic acid, glutamic acid, homocysteic acid and cysteic acid. In a further embodiment the B chain comprises the sequence $X_{22}VNQX_{25}LCGX_{29}X_{30}LVEALYLVCGERGFFYT$-$Z_1$-$B_1$ (SEQ ID NO: 34) wherein $X_{22}$ is selected from the group consisting of phenylalanine and desamino-phenylalanine;

$X_{25}$ is selected from the group consisting of histidine and threonine;

$X_{29}$ is selected from the group consisting of alanine, glycine and serine;

$X_{30}$ is selected from the group consisting of histidine, aspartic acid, glutamic acid, homocysteic acid and cysteic acid;

$Z_1$ is a dipeptide selected from the group consisting of aspartate-lysine, lysine-proline, and proline-lysine; and $B_1$ is selected from the group consisting of threonine, alanine or a threonine-arginine-arginine tripeptide.

In accordance with some embodiments the A chain comprises the sequence $GIVEQCCX_8SICSLYQLX_{17}NX_{19}CX_{23}$ (SEQ ID NO: 32) or $GIVDECCX_8X_9SCDLX_{14}X_{15}LX_{17}X_{18}X_{19}CX_{21}$-$R_{13}$ (SEQ ID NO: 35), and the B chain comprises the sequence $X_{25}LCGX_{29}X_{30}LVX_{33}X_{34}LYLVCGDX_{42}GFX_{45}$ (SEQ ID NO: 36) wherein $X_8$ is histidine or phenylalanine;

$X_9$ and $X_{14}$ are independently selected from arginine, lysine, ornithine or alanine;

$X_{15}$ is arginine, lysine, ornithine or leucine;

$X_{17}$ is glutamic acid or glutamine;

$X_{18}$ is methionine, asparagine or threonine;

$X_{19}$ is tyrosine, 4-methoxy-phenylalanine or 4-amino phenylalanine;

$X_{21}$ is alanine, glycine or asparagine;

$X_{23}$ is asparagine or glycine;

$X_{25}$ is selected from the group consisting of histidine and threonine;

$X_{29}$ is selected from the group consisting of alanine, glycine and serine;

$X_{30}$ is selected from the group consisting of histidine, aspartic acid, glutamic acid, homocysteic acid and cysteic acid;

$X_{33}$ is selected from the group consisting of aspartic acid and glutamic acid;

$X_{34}$ is selected from the group consisting of alanine and threonine;

$X_{42}$ is selected from the group consisting of alanine, lysine, omithine and arginine;

$X_{45}$ is tyrosine; and $R_{13}$ is COOH or $CONH_2$.

In a further embodiment the A chain comprises the sequence GIVDECC$X_8X_9$SCDL$X_{14}X_{15}$L$X_{17}X_{18}$ $X_{19}$C$X_{21}$-$R_{13}$ (SEQ ID NO: 35), and the B chain comprises the sequence $X_{25}$LCG$X_{29}X_{30}$LV$X_{33}X_{34}$LYLVCGD$X_{42}$GF$X_{45}$ (SEQ ID NO: 36) wherein $X_8$ is histidine;

$X_9$ and $X_{14}$ are independently selected from arginine, lysine, ornithine or alanine;

$X_{15}$ is arginine, lysine, omithine or leucine;

$X_{17}$ is glutamic acid, aspartic acid, asparagine, lysine, omithine or glutamine;

$X_{18}$ is methionine, asparagine or threonine;

$X_{19}$ is tyrosine, 4-methoxy-phenylalanine or 4-amino phenylalanine;

$X_{21}$ is alanine, glycine or asparagine;

$X_{23}$ is asparagine or glycine;

$X_{25}$ is selected from the group consisting of histidine and threonine;

$X_{29}$ is selected from the group consisting of alanine, glycine and serine;

$X_{30}$ is selected from the group consisting of histidine, aspartic acid, glutamic acid, homocysteic acid and cysteic acid;

$X_{33}$ is selected from the group consisting of aspartic acid and glutamic acid;

$X_{34}$ is selected from the group consisting of alanine and threonine;

$X_{42}$ is selected from the group consisting of alanine, lysine, omithine and arginine;

$X_{45}$ is tyrosine or phenylalanine and $R_{13}$ is COOH or $CONH_2$. In a further embodiment the A chain comprises the sequence GIVDECCH$X_9$ SCDL$X_{14}X_{15}$L$X_{17}$M$X_{19}$C$X_{21}$-$R_{13}$ (SEQ ID NO: 37), and the B chain comprises the sequence $X_{25}$LCGA$X_{30}$ LVDALYLVCGD$X_{42}$GF$X_{45}$ (SEQ ID NO: 38) wherein $X_9$, $X_{14}$ and $X_{15}$ are independently ornithine, lysine or arginine;

$X_{17}$ is glutamic acid or glutamine;

$X_{19}$ is tyrosine, 4-methoxy-phenylalanine or 4-amino phenylalanine;

$X_{21}$ is alanine, glycine or asparagine;

$X_{25}$ is selected from the group consisting of histidine and threonine;

$X_{30}$ is selected from the group consisting of histidine, aspartic acid and glutamic acid;

$X_{42}$ is selected from the group consisting of alanine, lysine, omithine and arginine;

$X_{45}$ is tyrosine or phenylalanine and $R_{13}$ is COOH or $CONH_2$. In one embodiment the B chain is selected from the group consisting of HLCGA-ELVDALYLVCGD$X_{42}$GFY (SEQ ID NO: 39), GPEHLCGAELVDALYLVCGD$X_{42}$GFY (SEQ ID NO: 40), GPEHLCGAELVDALYLVCGD$X_{42}$GFYFNPKT (SEQ ID NO: 41) and GPEHLCGAELVD ALYLVCGD$X_{42}$GFYFNKPT (SEQ ID NO: 42), wherein $X_{42}$ is selected from the group consisting of omithine, lysine and arginine. In a further embodiment the A chain comprises the sequence GIVDECCH$X_9$SCDL$X_{14}X_{15}$LQMYCN-$R_{13}$ (SEQ ID NO: 43), wherein $X_9$, $X_{14}$ and $X_{15}$ are independently omithine, lysine or arginine.

In another embodiment the A chain comprises the sequence GIVDECC$X_8$RSCDLYQLEN$X_{19}$CN-$R_{13}$ (SEQ ID NO: 44) and the B chain comprises the sequence $R_{22}$-$X_{25}$LCGSHLVDALYLVCGD$X_{42}$GF$X_{45}$ (SEQ ID NO: 45) wherein $X_8$ is threonine, histidine or phenylalanine;

$X_{19}$ is tyrosine, 4-methoxy-phenylalanine or 4-amino phenylalanine;

$X_{25}$ is histidine or threonine;

$X_{42}$ is alanine, ornithine or arginine;

$X_{45}$ is tyrosine histidine, asparagine or phenylalanine;

$R_{22}$ is selected from the group consisting of AYRPSE (SEQ ID NO: 14), FVNQ (SEQ ID NO: 12), PGPE (SEQ ID NO: 11), a tripeptide glycine-proline-glutamic acid, a tripeptide valine-asparagine-glutamine, a dipeptide proline-glutamic acid, a dipeptide asparagine-glutamine, glutamine, glutamic acid and a bond; and $R_{13}$ is COOH or $CONH_2$. and $R_{13}$ is COOH or $CONH_2$.

In another embodiment the A chain comprises the sequence GIVEQCCHSICSLYQLEN$X_{19}$C$X_{21}$-$R_{13}$ (SEQ ID NO: 46) or GIVDECCHRSCDLRRLEM$X_{19}$C$X_{21}$-$R_{13}$ (SEQ ID NO: 47); and the B chain comprises the sequence FVNQHLCGSHLVEALYLVCGERGFFYTPKT (SEQ ID NO: 2), or GPETLCGAELVDALYLVCGDRGFYFNPKT (SEQ ID NO: 48)

wherein $X_{19}$ is tyrosine, 4-methoxy phenylalanine or 4-amino-phenylalanine;

$X_{21}$ is alanine, glycine or asparagine $X_{26}$ and $X_{27}$ are each alanine; and $X_{42}$ is arginine.

Single Chain Insulin Peptide Agonists

As disclosed herein linking moieties can be used to link human insulin A and B chains, or analogs or derivatives thereof, wherein the carboxy terminus of the B25 amino acid of the B chain is directly linked to a first end of a linking moiety, wherein the second end of the linking moiety is directly linked to the amino terminus of the A1 amino acid of the A chain via the intervening linking moiety.

In accordance with one embodiment the insulin peptide is a single chain insulin agonist that comprises the general structure B-LM-A wherein B represents an insulin B chain, A represents an insulin A chain, and LM represents a linking moiety linking the carboxy terminus of the B chain to the amino terminus of the A chain. Suitable linking moieties for joining the B chain to the A chain are disclosed herein under the header Linking Moieties for Single Chain-Insulin Analogs and the respective subheaders "Peptide linkers" and "Non-Peptide Linkers". In one embodiment the linking moiety comprises a linking peptide, and more particularly, in one embodiment the peptide represents an analog of the IGF-1 C peptide. Additional exemplary peptide linkers include but are not limited to the sequence $X_{51}X_{52}GSSSX_{57}X_{58}$ (SEQ ID NO: 49) or $X_{51}X_{52}GSSSX_{57}X_{58}APQT$ (SEQ ID NO: 50) wherein $X_{51}$ is selected from the group consisting of glycine, alanine, valine, leucine, isoleucine and proline, $X_{52}$ is alanine, valine, leucine, isoleucine or proline and $X_{57}$ or $X_{58}$ are independently arginine, lysine, cysteine, homocysteine, acetyl-phenylalanine or ornithine, optionally with a hydrophilic moiety linked to the side chain of the amino acid at position 7 or 8 of the linking moiety (i.e., at the $X_{57}$ or $X_{58}$ position). Amino acid positions of the linking moiety are designated based on the corresponding position in the native C chain of IGF 1 (SEQ ID NO: 17). In another embodiment the peptide linking moiety comprises a 29 contiguous amino acid sequence having greater than 70%, 80%, 90% sequence identity to $SSSSX_{50}APPPSLPSPSRLPGPSDTPILPQX_{51}$ (SEQ ID NO: 68), wherein $X_{50}$ and $X_{51}$ are independently selected from arginine and lysine. In one embodiment the linking moiety is a non-peptide linker comprising a relatively short bifunctional non-peptide polymer linker that approximates the length of an 8-16 amino acid sequence. In one embodiment the non-peptide linker has the structure:

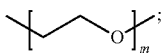

wherein m is an integer ranging from 10 to 14 and the linking moiety is linked directly to the B25 amino acid of the B chain. In accordance with one embodiment the non-peptide linking moiety is a polyethylene glycol linker of approximately 4 to 20, 8 to 18, 8 to 16, 8 to 14, 8 to 12, 10 to 14, 10 to 12 or 11 to 13 monomers.

In one embodiment a glucagon related peptide-insulin conjugate is provided that comprises an insulin peptide having the structure: IB-LM-IA, wherein IB comprises the sequence $R_{22}$-$X_{25}LCGX_{29}X_{30}LVX_{33}X_{34}LYL$- $VCGX_{41}X_{42}GFX_{45}$ (SEQ ID NO: 20), LM is a linking moiety as disclosed herein that covalently links IB to IA, and IA comprises the sequence $GIVX_4X_5CCX_8X_9X_{10}CX_{12}LX_{14}X_{15}LX_{17}X_{18}X_{19}CX_{21}$-$R_{13}$ (SEQ ID NO: 29), wherein $X_4$ is glutamic acid or aspartic acid;

$X_5$ is glutamine or glutamic acid;

$X_8$ is histidine or phenylalanine;

$X_9$ and $X_{14}$ are independently selected from arginine, lysine, ornithine or alanine;

$X_{10}$ is isoleucine or serine;

$X_{12}$ is serine or aspartic acid;

$X_{14}$ is tyrosine, arginine, lysine, ornithine or alanine;

$X_{15}$ is arginine, lysine, ornithine or leucine;

$X_{17}$ is glutamic acid or glutamine;

$X_{18}$ is methionine, asparagine or threonine;

$X_{19}$ is tyrosine, 4-methoxy-phenylalanine or 4-amino phenylalanine;

$X_{21}$ is alanine, glycine or asparagine;

$X_{25}$ is selected from the group consisting of histidine and threonine;

$X_{29}$ is selected from the group consisting of alanine, glycine and serine;

$X_{30}$ is selected from the group consisting of histidine, aspartic acid, glutamic acid, homocysteic acid and cysteic acid;

$X_{33}$ is selected from the group consisting of aspartic acid and glutamic acid;

$X_{34}$ is selected from the group consisting of alanine and threonine;

$X_{41}$ is selected from the group consisting of glutamic acid, aspartic acid or asparagine;

$X_{42}$ is selected from the group consisting of alanine, lysine, ornithine and arginine;

$R_{22}$ is selected from the group consisting of AYRPSE (SEQ ID NO: 14), FVNQ (SEQ ID NO: 12), PGPE (SEQ ID NO: 11), a tripeptide glycine-proline-glutamic acid, a tripeptide valine-asparagine-glutamine, a dipeptide proline-glutamic acid, a dipeptide asparagine-glutamine, glutamine, glutamic acid and an N-terminal amine; and $R_{13}$ is COOH or $CONH_2$, further wherein the amino acid at the designation $X_{45}$ is directly bound to the linking moiety, LM (i.e., the designation IB-LM-IA as used herein is intended to represent that the B chain carboxyl terminus and the amino terminus of the A chain are directly linked to the linking moiety LM without any further intervening amino acids).

In one embodiment the linking moiety (LM) comprises an amino acid sequence of no more than 17 amino acids in length. In one embodiment the linking moiety comprises the sequence $X_{51}X_{52}GSSSX_{57}X_{58}$ (SEQ ID NO: 49) or $X_{51}X_{52}GSSSX_{57}X_{58}APQT$ (SEQ ID NO: 50) wherein $X_{51}$ is selected from the group consisting of glycine, alanine, valine, leucine, isoleucine and proline, $X_{52}$ is alanine, valine, leucine, isoleucine or proline and $X_{57}$ or $X_{58}$ are independently arginine, lysine, cysteine, homocysteine, acetyl-phenylalanine or ornithine, optionally with a hydrophilic moiety linked to the side chain of the amino acid at position 7 or 8 of the linking moiety (i.e., at the $X_{57}$ or $X_{58}$ position). Amino acid positions of the linking moiety are designated based on the corresponding position in the native C chain of IGF 1 (SEQ ID NO: 17).

In another embodiment the linking moiety comprises a 29 contiguous amino acid sequence, directly linked to the carboxy terminal amino acid of the B chain, wherein said 29 contiguous amino acid sequence has greater than 70%, 80%, 90% sequence identity to $SSSSX_{50}APPPSL$-$PSPSR$-$LPGPSDTPILPQX_{51}$ (SEQ ID NO: 68), wherein $X_{50}$ and $X_{15}$ are independently selected from arginine and lysine. In one embodiment the linking peptide comprises a total of 29 to 158 or 29 to 58 amino acids and comprises the sequence of SEQ ID NO: 68. In another embodiment the linking moiety comprises a 29 contiguous amino acid sequence, directly linked to the carboxy terminal amino acid of the B chain, wherein said 29 contiguous amino acid sequence has greater than 90% sequence identity to $SSSSX_{50}APPPSLPSPSRLPGPSDTPILPQX_{51}$ (SEQ ID NO: 68), wherein $X_{50}$ and $X_{15}$ are independently selected from arginine and lysine. In one embodiment the linking moiety comprises the sequence SSSSRAPPPSLPSPSR-LPGPSDTPILPQK (SEQ ID NO: 51) or SSSSKAP-PPSLPSPSRLPGPSDTPILPQR (SEQ ID NO: 52) optionally with one or two amino acid substitutions.

In accordance with one embodiment a single chain insulin agonist polypeptide is provided comprising a B chain and A chain of human insulin, or analogs or derivative thereof, wherein the last five carboxy amino acids of the native B chain are deleted (i.e., B26-B30), and amino acid B25 is linked to amino acid A1 of the A chain via an intervening linking moiety. In one embodiment the linking moiety comprises the structure:

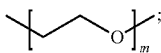

wherein m is an integer ranging from 10 to 14 and the linking moiety is linked directly to the B25 amino acid of the B chain.

In one embodiment a glucagon related peptide-insulin conjugate is provided comprising an insulin peptide having the general formula IB-LM-IA wherein IB comprises the sequence GPEHLCGAX$_{30}$LVDALYLVCGDX$_{42}$GFYFNX$_{48}$X$_{49}$ (SEQ ID NO: 1922); LM comprises the sequence SSSS-RAPPPSLPSPSRLPGPSDTPILPQK (SEQ ID NO: 51), SSSSKAPPPSLPSPSRLPGPSDTPILPQR (SEQ ID NO: 52), GYGSSSRR (SEQ ID NO: 18) or GAGSSSRR (SEQ ID NO: 22); and IA comprises the sequence GIVDECCXX$_9$SCDLX$_{14}$X$_{15}$LX$_{17}$X$_{18}$X$_{19}$CX$_{21}$-R$_{13}$ (SEQ ID NO: 35) wherein X$_8$ is histidine or phenylalanine;
X$_9$ is arginine, ornithine or alanine;
X$_{14}$ and X$_{15}$ are both arginine;
X$_{17}$ is glutamic acid;
X$_{19}$ is tyrosine, 4-methoxy-phenylalanine or 4-amino phenylalanine;
X$_{21}$ is alanine or asparagine;
X$_{25}$ is histidine or threonine;
X$_{30}$ is selected from the group consisting of histidine, aspartic acid, glutamic acid, homocysteic acid and cysteic acid;
X$_{42}$ is selected from the group consisting of alanine, ornithine and arginine;
X$_{48}$ is lysine or aspartic acid;
X$_{49}$ is proline, ornithine or arginine;
R$_{13}$ is COOH.

Linking Moieties for Single Chain Insulin Analogs

Peptide Linkers

In accordance with one embodiment the linking moiety is a peptide or peptidomimetic of 6-18, 8-18, 8-17, 8-12, 8-10, 13-17 or 13-15 amino acids (or amino acid analogs or derivatives thereof). In one embodiment the linking moiety is a peptide or peptidomimetic of 6-18, 8-18, 8-17, 8-12, 8-10, 13-17 or 13-15 amino acids wherein the peptide linking moiety comprises two or more adjacent basic amino acid residues. In accordance with one embodiment the linking moiety is an 8 to 17 non-native amino acid sequence comprising the sequence X$_{51}$X$_{52}$X$_{53}$X$_{54}$X$_{55}$X$_{56}$X$_{57}$X$_{58}$ (SEQ ID NO: 9), wherein X$_{51}$, X$_{52}$, X$_{53}$, X$_{54}$, X$_{55}$ and X$_{56}$ are independently any amino acid or amino acid analog or derivative thereof, and X$_{57}$ and X$_{58}$ are basic amino acids. In one embodiment the linking moiety is a non-native polypeptide of 8 to 17 amino acids in length and comprising the sequence X$_{51}$X$_{52}$X$_{53}$X$_{54}$X$_{55}$X$_{56}$RR (SEQ ID NO: 10), wherein X$_{52}$ is a non-aromatic amino acid, including for example alanine. In one embodiment the linking moiety is 8 to 17 amino acids in length and comprises the sequence X$_{51}$X$_{52}$GSSSRR (SEQ ID NO: 53) wherein X$_{51}$ is selected from the group consisting of glycine, alanine, valine, leucine, isoleucine, proline and methionine, and X$_{52}$ is a non-aromatic amino acid, including for example alanine. In one embodiment the linking moiety is 8 to 17 amino acids in length and comprises a sequence that differs from X$_{51}$X$_{52}$GSSSRR (SEQ ID NO: 53) by a single amino acid substitution wherein the amino acid substitution is an amino acid that is pegylated at its side chain, further wherein X$_{15}$ is selected from the group consisting of glycine, alanine, valine, leucine, isoleucine, proline and methionine, and X$_{52}$ is a non-aromatic amino acid, including for example alanine.

In accordance with one embodiment the linking moiety is a derivative of the IGF 1 C chain sequence (GYGSSSRRAPQT; SEQ ID NO: 17). In one embodiment the derivative is a peptide that differs from SEQ ID NO: 17 by a single amino acid substitution of a lysine, cysteine ornithine, homocysteine, or acetyl-phenylalanine residue, and in a further embodiment the lysine, cysteine ornithine, homocysteine, or acetyl-phenylalanine amino acid is pegylated. In one further embodiment the linking moiety is a peptide that differs from SEQ ID NO: 17 by a single lysine substitution. In one specific embodiment the substitution is made at position 8 of SEQ ID NO: 17. Applicants have discovered that use of the IGF 1 C chain sequence and analogs thereof as a linking moiety will generate a single chain insulin polypeptide that has near wild type insulin activity. Furthermore, use of a IGF 1 C chain sequence analog as the linking moiety, wherein position 2 of the IGF 1 C chain sequence is modified, or the carboxy terminal four amino acids are deleted from the IGF 1 C chain sequence, produces a single chain insulin polypeptide that is selective for insulin (i.e., has a higher binding and/or activity at the insulin receptor compared to the IGF-1 receptor). In one embodiment the single chain insulin polypeptide has 5×, 10×, 20×, 30×, 40×, or 50× higher affinity or activity at the insulin receptor relative to the IGF-1 receptor.

In accordance with one embodiment the linking moiety is a derivative of the IGF 1 C chain sequence (GYGSSSRRAPQT; SEQ ID NO: 17) and comprises a non-native sequence that differs from GYGSSSRR (SEQ ID NO: 18) or GAGSSSRRAPQT (SEQ ID NO: 23) by 1 to 3 amino acid substitutions, or 1 to 2 amino acid substitutions. In one embodiment at least one of the amino acid substitutions is a lysine or cysteine substitution, and in one embodiment the amino acid substitutions are conservative amino acid substitutions. In one embodiment the linking moiety is a peptide (or peptidomimetic) of 8 to 17 amino acids comprising a non-native amino acid sequence that differs from GYGSSSRR (SEQ ID NO: 18) or GAGSSSRRAPQT (SEQ ID NO: 23) by 1 amino acid substitution, including for example substitution with a lysine or cysteine. In one embodiment the linking moiety comprises the sequence GYGSSSRR (SEQ ID NO: 18) or GAGSSSRRAPQT (SEQ ID NO: 23). In one embodiment the linking moiety comprises the sequence GAGSSSRX$_{58}$APQT (SEQ ID NO: 54), GYGSSSX$_{57}$X$_{58}$APQT (SEQ ID NO: 69), or an amino acid that differs from SEQ ID NO: 54 by a single amino acid substitution, wherein X$_{57}$ is arginine and X$_{58}$ is arginine, ornithine or lysine, and in a further embodiment a polyethylene glycol chain is linked to the side chain of the amino acid at position 8 of said linking moiety. In another embodiment the linking moiety comprises the sequence GX$_{52}$GSSSRX$_5$ssAPQT (SEQ ID NO: 55), wherein X$_{52}$ is any non-aromatic amino acid, including for example, alanine, valine, leucine, isoleucine or proline, and X$_{58}$ represents an amino acid that has a polyethylene chain covalently linked to its side chain. In one embodiment X$_{58}$ is a pegylated lysine.

In another embodiment, the linking moiety is an 8 to 17 amino acid sequence comprising the sequence GX$_{52}$GSSSRR (SEQ ID NO: 56), wherein X$_{52}$ is any amino acid, a peptidomimetic of SEQ ID NO: 31, or an analog thereof that differs from SEQ ID NO: 31 by a single amino acid substitution at any of positions 1, 3, 4, 5, 6, 7 or 8 of SEQ ID NO: 31, with the proviso that when the linking peptide is longer than 8 amino acids X$_{52}$ is other than tyrosine. In accordance with one embodiment the linking moiety comprises an 8-17 amino acid sequence selected from the group consisting of GYGSSSRR (SEQ ID NO: 18), GAGSSSRR (SEQ ID NO: 22), GAGSSSRRA (SEQ ID NO: 57), GAGSSSRRAP (SEQ ID NO: 58), GAGSSSRRAPQ (SEQ ID NO: 59), GAGSSSRRAPQT (SEQ ID NO: 23), PYGSSSRR (SEQ ID NO: 61), PAGSSSRR (SEQ ID NO: 62), PAGSSSRRA (SEQ ID NO: 63), PAGSSSRRAP (SEQ ID NO: 64), PAGSSSRRAPQ (SEQ ID NO: 65), PAGSSSRRAPQT (SEQ ID NO: 66). In accordance with one embodiment the linking moiety comprises an amino acid sequence that differs from GYGSSSRR (SEQ ID NO: 18), GAGSSSRR (SEQ ID NO: 22), GAGSSSRRA (SEQ ID NO: 57), GAGSSSRRAP (SEQ ID NO: 58), GAGSSSRRAPQ (SEQ ID NO: 59), GAGSSSRRAPQT (SEQ ID NO: 23), PYGSSSRR (SEQ ID NO: 61), PAGSSSRR (SEQ ID NO: 62), PAGSSSRRA (SEQ ID NO: 63), PAGSSSRRAP (SEQ ID NO: 64), PAGSSSRRAPQ (SEQ ID NO: 65), PAGSSSRRAPQT (SEQ ID NO: 66) by a single pegylated amino acid including for example a pegylated lysine or pegylated cysteine amino acid substitution. In one embodiment the pegylated amino acid is at position 8 of the linking moiety.

In one embodiment a peptide sequence named C-terminal peptide (CTP: SSSSKAPPPSLPSPSRLPGPSDTPILPQR; SEQ ID NO: 52), which is prone to O-linked hyperglycosylation when the protein is expressed in a eukaryotic cellular expression system, can be used as a linker peptide. Surprisingly, applicants have discovered that the CTP peptide can be used to connect the B and A chains of insulin to form a single chain insulin analog while still maintaining high in vitro potency in a manner that the native proinsulin C-peptide can not. In one embodiment a glucagon related peptide-insulin conjugate is prepared comprising an insulin peptide having the carboxy terminus of the B chain linked to the amino terminus of the A chain via a CTP peptide. In another embodiment an insulin analog is provided as a two-chain construct with the CTP covalently linked to the C-terminus of the B-chain and/or the amino terminus of the B chain. In vitro and in vivo characterization reveals the CTP modified insulin analogs to have high potency in the absence of glycosylation, thus providing a mechanism to extend insulin action that is based on glycosylation, a natural approach to longer duration proteins.

Applicants have discovered that the primary sequence of the CTP peptide does not appear to be critical. Accordingly, in one embodiment the linking moiety comprises a peptide having a length of at least 18 amino acids that shares a similar amino acid content. In one embodiment the linking moiety comprises an analog of (SEQ ID NO: 68), wherein said analog differs from (SEQ ID NO: 68) by 1, 2, 3, 4, 5 or 6 amino acid substitutions. In one embodiment the linking peptide comprises a CTP peptide wherein amino acid substitutions are made at one or more positions selected from positions 1, 2, 3, 4, 10, 13, 15, and 21 of (SEQ ID NO: 68). In one embodiment the linking moiety comprises a 29 contiguous amino acid sequence, directly linked to the carboxy terminal amino acid of the B chain, wherein said 29 contiguous amino acid sequence has greater than 60, 80 or 90% sequence identity to SSSSX$_{50}$APPPS-LPSPSR-LPGPSDTPILPQX$_{51}$ (SEQ ID NO: 68), with the proviso that the sequence does not comprise a 15 amino acid sequence identical to a 15 amino acid sequence contained within SEQ ID NO 53. In another embodiment the linking moiety comprises a 29 contiguous amino acid sequence, directly linked to the carboxy terminal amino acid of the B chain, wherein at least 58% of the amino acids comprising the 29 contiguous amino acid sequence are selected from the group consisting of serine and proline.

In another embodiment the linking moiety comprises a 29 contiguous amino acid sequence, directly linked to the carboxy terminal amino acid of the B chain, wherein said 29 contiguous amino acid sequence has greater than 70%, 80%, 90% sequence identity to SSSSX$_{50}$APPPSL-PSPSR-LPGPSDTPILPQX$_{51}$ (SEQ ID NO: 68), wherein X$_{50}$ and X$_{51}$ are independently selected from arginine and lysine, with the proviso that the sequence does not comprise a 15 amino acid sequence identical to a 15 amino acid sequence contained within SEQ ID NO 53. In another embodiment the linking moiety comprises a 29 contiguous amino acid sequence, directly linked to the carboxy terminal amino acid of the B chain, wherein said 29 contiguous amino acid sequence is an analog of (SEQ ID NO: 52), wherein said analog differs from (SEQ ID NO: 52) only by 1, 2, 3, 4, 5 or 6 amino acid modification, and in a further embodiment the amino acid modifications are conservative amino acid substitutions. In another embodiment the linking moiety comprises a 29 contiguous amino acid sequence, directly linked to the carboxy terminal amino acid of the B chain, wherein said 29 contiguous amino acid sequence is an analog of (SEQ ID NO: 52), wherein said analog differs from (SEQ ID NO: 52) only by 1, 2 or 3 amino acid substitutions.

Applicants have also found that multiple copies of the CTP peptide can be used as the linking peptide in single chain analogs and/or linked to the amino terminus of the B chain in single chain or two chain insulin analogs. The multiple copies of the CTP peptide can be identical or can differ in sequence and can be arranged in a head to tail or head to head orientation. In accordance with one embodiment an insulin analog is provided comprising a CTP peptide having the sequence (SSSSX$_{50}$APPPS-LPSPSR-LPGPSDTPILPQX$_{51}$)$_n$ (SEQ ID NO: 68), wherein n is an integer selected from the group consisting of 1, 2, 3 and 4 and X$_{50}$ and X$_{51}$ are independently selected from arginine and lysine.

In one embodiment the CTP peptide comprises the sequence SSSSX$_{50}$APPPSLPSPSRLPGPSDTPILPQX$_{51}$ (SEQ ID NO: 68), wherein X$_{50}$ and X$_{51}$ are independently selected from arginine and lysine. In another embodiment the CTP peptide comprises a sequence selected from the group consisting of SSSSRAPPPSLPSPSRLPGPSDTPILPQK (SEQ ID NO: 51), SSSSKAPPPSLPSPSRLPGPSDTPILPQR (SEQ ID NO: 52) or SSSSRAPPPSLPSPSRLPGPSDTPILPQ (SEQ ID NO: 67), and in a further embodiment the CTP peptide comprises the sequence SSSSRAPPPSLPSPSRLPGPSDTPILPQK (SEQ ID NO: 53).

Glycosylation

During nascent in vivo protein production insulin analogs comprising glycosylation sites may undergo further processing, known as post-translational modification, wherein sugar (glycosyl) residues may be added enzymatically in a process known as glycosylation. The resulting proteins bearing covalently linked oligosaccharide side chains are known as glycosylated proteins or glycoproteins. Accordingly, a protein that bears a glycosylation site is not necessarily glycosylated. In accordance with one embodiment insulin agonists analogs are provided that have been modified to comprise a peptide sequence that is prone to hyperglycosylation when expressed in a eukaryotic expression system.

Non-native and native glycosylation sequences are known to those skilled in the art and include N-linked glycosylation sites, and O-linked glycosylation sites. N-linked glycosylation sites are peptide sequences that serve as recognition sites for enzymatic attachment of a carbohydrate moiety to the side chain of an asparagine residue. The tripeptide O-linked glycosylation sequences include asparagine-X-serine and asparagine-X-threonine, where X is any amino acid except proline. Thus, the presence of either of these tripeptide sequences in a polypeptide creates a potential glycosylation site. O-linked glycosylation are peptide sequences that serve as recognition sites for enzymatic attachment of a carbohydrate moiety to the side chain of a hydroxyamino acid, most commonly serine or threonine, although 5-hydroxyproline or 5-hydroxylysine may also be used. In one embodiment the O-linked glycosylation sugar is N-aceylgalactosamine, galactose, or xylose. A number of O-linked glycosylation sites are known in the art and have been reported in the literature. See, e.g., Ten Hagen et al. (11029) J. Biol. Chem. 274(39):27867-74; Hanisch et al. (2001) Glycobiology 11:731-740; and Ten Hagen et al. (2003) Glycobiology 13:1R-16R.

In accordance with one embodiment a method of producing a hyperglycosylated insulin analog is provided. The method comprises providing a eukaryotic host cell that comprises a gene encoding an insulin analog that has been modified to include a non-native glycosylation site (e.g., a CTP peptide sequence) and culturing the cell under conditions that allow expression of the insulin analog gene. In one embodiment the host cell expresses human glycosylation enzymes such that glycosylated proteins (glycoproteins) produced in the host cell exhibit protein glycosylation identical to that of human cells (see US Patent Application Publication Nos. 2004/0018590 and 2002/0137134, the disclosures of which are incorporated herein by reference). In accordance with one embodiment the eukaryotic host cell is selected from yeast (e.g., *Pichia pastoris*) or mammalian (CHO or HEK293) cells.

In accordance with one embodiment an insulin analog is provided wherein a glycosylation site has been introduced into the insulin peptide. In one embodiment an insulin analog, either a two chain or single chain analog, is provided wherein a peptide comprising a glycosylation site has been linked to the carboxy terminus of the insulin B chain. In one embodiment a single chain insulin analog is provided comprising a linking moiety that covalently joins the carboxy terminus of an insulin B chain to the amino terminus of an insulin A chain, wherein the linking moiety comprises an amino acid sequence of greater than 18 residues and comprises one or more glycosylation sites. In a further embodiment an insulin analog is provided comprising two peptide sequences that each contain at least one glycosylation site (either the same or different). In one embodiment, a first peptide sequence containing a glycosylation site is linked to the N terminus of the B chain and the second peptide sequence containing a glycosylation site is linked to the C-terminus of the A or B chain. In one embodiment the insulin analog is a single chain analog wherein the linking moiety joining the B and A chains comprises the second peptide sequence.

In one embodiment a glycosylation site is introduced by the addition of amino acid sequences to the base insulin analog. More particularly, applicants have discovered that peptide sequence named C-terminal peptide (CTP: SSSSKAPPPSLPSPSRLPGPSDTPILPQR; SEQ ID NO: 52), which is prone to O-linked hyperglycosylation when the protein is expressed in a eukaryotic cellular expression system can be covalently linked to an insulin analog without undermining the inherent in vitro activity of the insulin analog.

In accordance with one embodiment an insulin analog is provided comprising A chain and a B chain and a CTP peptide, wherein the CTP peptide is a peptide having at least 60, 70, 80, 85, 90, or 95% sequence identity with (SEQ ID NO: 52). In one embodiment the CTP peptide is a peptide comprising a 18 to 29 amino acid sequence that shares at least 80, 82, 84, 86, 88, 90, 92, 94, 96 or 98% sequence identity with a 18 to 29 amino acid region of (SEQ ID NO: 52). In one embodiment the CTP peptide comprises an analog of (SEQ ID NO: 52), wherein said analog differs from (SEQ ID NO: 52) by 1, 1 to 2, 3 to 4, 4 to 6 or up to 8 amino acid substitutions. In one embodiment the amino acid substitution are at one or more positions selected from 1-4, 7-15, 18, 20, 21, 24 and 27 of (SEQ ID NO: 52). In one embodiment the amino acid substitution are at one or more positions selected from 1, 2, 3, 4, 10, 13, 15, and 21 of (SEQ ID NO: 52). In one embodiment the amino acid substitution are at one or more positions selected from 7, 8, 9, 12, 14, 18, 20, 24 and 27 of (SEQ ID NO: 52). In one embodiment the CTP peptide comprises a 29 amino acids sequence that differs from SEQ ID NO: 68 by 1 to 2 amino acid substitutions. In a further embodiment the CTP peptide comprises a fragment of SEQ ID NO: 52 wherein the fragment represents a 18 to 28 contiguous amino acid sequence identical to an amino acid sequence contained within SEQ ID NO: 52. In one embodiment the CTP peptide consists of SEQ ID NO: 68, SEQ ID NO: 52 or SEQ ID NO: 51.

In accordance with one embodiment the CTP peptide comprises a peptide of the sequence $SSSSX_{50}$ APPPSLPSPSRLPGPSDTPILPQX$_{51}$ (SEQ ID NO: 68), wherein $X_{50}$ and $X_{51}$ are independently arginine or lysine, or a peptide that differs from $SSSSX_{50}$ APPPSLPSPSR-LPGPSDTPILPQX$_{51}$ (SEQ ID NO: 68) by one or two amino acid modifications. In one embodiment the CTP peptide is a 29 amino acid sequence comprising a sequence selected from the group consisting of SSSSRAPPPSLPSPSR-LPGPSDTPILPQK (SEQ ID NO: 51), SSSSKAPPPSLPSPSRLPGPSDTPILPQR (SEQ ID NO: 52) and SSSSRAPPPSLPSPSRLPGPSDTPILPQ (SEQ ID NO: 67). In one embodiment the CTP peptide comprises the sequence $(SSSSX_{50}APPPSLPSPSRLPGPSDTPILPQX_{51})_n$ (SEQ ID NO: 68), wherein n is an integer selected from the group consisting of 1, 2, 3 and 4, and in a further embodiment n is 1 or 2. In a further embodiment a first CTP peptide is linked to the N-terminus of the B chain and a second CTP peptide is linked to the carboxy terminus of the B chain, wherein the first and second CTP peptides comprise sequences independently selected from the group consisting of SEQ ID NO: 51, SEQ ID NO: 52, SEQ ID NO: 68 and SEQ ID NO: 67.

Non-Peptide Linkers

In one embodiment the linking moiety is a relatively short bifunctional non-peptide polymer linker that approximates the length of an 8-16 amino acid sequence. In accordance with one embodiment the non-peptide linking moiety is a polyethylene glycol linker of approximately 4 to 20, 8 to 18, 8 to 16, 8 to 14, 10 to 14, 10 to 12 or 11 to 13 monomers. In one embodiment a single chain insulin agonist is provided wherein the last five carboxy amino acids of the native B chain are deleted, and amino acid B25 is directly linked to the linking moiety by a covalent bond. The second end of the linking moiety is covalently bound to amino acid A1 of the A chain thus linking the B and A chain via the linking moiety. In one embodiment the linking moiety is a linear polyethylene glycol linking moiety comprising at least 10 but no more than 16 monomer units and in another embodiment the polyethylene glycol linking moiety comprises at least 12 but no more than 16 monomer units, and in a further embodiment the polyethylene glycol linking moiety comprises at least 10 but no more than 14 monomer units.

In accordance with one embodiment the polyethylene glycol linking moiety comprises the structure:

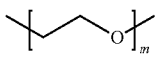

wherein m is an integer ranging from 6 to 18, 8 to 16, 10 to 14 or 11 to 13. In one embodiment m is an integer selected from 10, 11, 12, 13 or 14. In one embodiment m is 12.

In one embodiment a single chain insulin agonist is provided wherein the last five carboxy amino acids of the native B chain are deleted, and amino acid B25 is linked to amino acid A1 of the A chain via a linking moiety comprising polyethylene glycol of at least 8 but no more than 16 monomer units and an amino acid sequence of one to four amino acids. In accordance with one embodiment the linking moiety comprises a 1-4 amino acid sequence and a linear polyethylene glycol of at least 8 but less than 14 monomer units in length covalently bound to said 1-4 amino acid sequence, with the proviso that the amino acid sequence is not YTPK (SEQ ID NO: 70) or FNKP (SEQ ID NO: 71). In another embodiment a single chain insulin agonist is provided wherein the last five carboxy amino acids of the native B chain are deleted, and amino acid B25 is linked to amino acid A1 of the A chain via a linking moiety comprising a polyethylene glycol of at least 8 but less than 14 monomer units in length and a 2-5 amino acid sequence. The 2-5 amino acid sequence can be located between the B chain and the polyethylene glycol chain or between the A chain and the polyethylene glycol chain. However, when the 2-5 amino acid sequence is located between the B chain and the polyethylene glycol chain, the amino acid sequence is not YTPKT (SEQ ID NO: 16) or FNKPT (SEQ ID NO: 76).

In one embodiment the linking moiety comprises the general structure: $W_1$-$Z_1$-$Y_1$
wherein
$W_1$ and $Y_1$ are independently a bond, $X_{46}$, $X_{46}X_{47}$, $X_{46}X_{47}X_{48}$, $X_{46}X_{47}X_{48}X_{49}$ (SEQ ID NO: 24) or $X_{46}X_{47}X_{48}X_{49}X_{50}$ (SEQ ID NO: 13), with the proviso that $W_1$ is not YTPK (SEQ ID NO: 70) or FNKP (SEQ ID NO: 71) and $Z_1$ represents a polyethylene glycol of the general structure

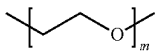

wherein m is an integer ranging from 6-14, and each of $X_{46}$, $X_{47}$, $X_{48}$, $X_{49}$ and $X_{50}$ are independently any amino acid. In one embodiment $X_{46}$, $X_{47}$, $X_{48}$, $X_{49}$ and $X_{50}$ are independently any non-native amino acid relative to positions B26-B30 of insulin or IGF-1. In one embodiment $X_{46}$, $X_{47}$, $X_{48}$, $X_{49}$ and $X_{50}$ are independently selected from the group consisting of glycine, alanine, valine, leucine, isoleucine, serine, threonine and proline, and in a further embodiment $X_{46}$, $X_{47}$, $X_{48}$, $X_{49}$ and $X_{50}$ are independently selected from the group consisting of glycine, alanine, valine, leucine and isoleucine. In one embodiment, $W_1$ is a bond and $Y_1$ is $X_{46}$, $X_{46}X_{47}$ or $X_{46}X_{47}X_{48}$ (SEQ ID NO: 15) wherein $X_{46}$, $X_{47}$ and $X_{48}$ are each alanine and Z is a polyethylene glycol of 4-14 monomer units. In one embodiment, $Y_1$ is a bond and $W_1$ is $X_{46}$, $X_{46}X_{47}$ or $X_{46}X_{47}X_{48}$ (SEQ ID NO: 15) wherein $X_{46}$, $X_{47}$ and $X_{48}$ are each alanine and Z is a polyethylene glycol of 4-14 monomer units.

In one embodiment a single chain insulin analog is provided comprising an A chain and a C-terminally truncated B chain, having amino acids B26-B30 (relative to the native insulin sequence) removed, wherein said A chain and B chain are human insulin sequences, or analogs or derivatives thereof, further wherein the carboxy terminus of the B25 amino acid of the B chain is directly linked to a first end of a linking moiety and a second end of the linking moiety is directly linked to the amino terminus of the A1 amino acid of the A chain. In one embodiment the truncated B chain comprises the sequence of SEQ ID NO: 20 wherein the B25 amino acid is directly linked to the N terminus of the linking peptide. In this embodiment the linking moiety comprises either
 a) a polyethylene glycol of 6-16 monomer units;
 b) a non-native amino acid sequence of at least 8 amino acids and no more than 17 amino acid in length; or
 c) a combination of said polyethylene glycol and a non-native amino acid sequence of 1 to 4 amino acids;

Pegylation of Insulin Peptides

Applicants have discovered that covalent linkage of a hydrophilic moiety to the insulin single chain analogs disclosed herein provide analogs having slower onset, extended duration and exhibit a basal profile of activity. In one embodiment, the insulin peptides disclosed herein are further modified to comprise a hydrophilic moiety covalently linked to the side chain of an amino acid at a position selected from the group consisting of A9, A14 and A15 of the A chain or at the N-terminal alpha amine of the B chain (e.g. at position B1 for insulin based B chain or position B2 for IGF-1 based B chain) or at the side chain of an amino acid at position B1, B2, B10, B22, B28 or B29 of the B chain or at any position of the linking moiety that links the A chain and B chain. In exemplary embodiments, this hydrophilic moiety is covalently linked to a Lys, Cys, Orn, homocysteine, or acetyl-phenylalanine residue at any of these positions. In one embodiment the hydrophilic moiety is covalently linked to the side chain of an amino acid of the linking moiety.

Exemplary hydrophilic moieties include polyethylene glycol (PEG), for example, of a molecular weight of about 1,000 Daltons to about 40,000 Daltons, or about 20,000 Daltons to about 40,000 Daltons. Additional suitable hydrophilic moieties include, polypropylene glycol, polyoxyethylated polyols (e.g., POG), polyoxyethylated sorbitol, polyoxyethylated glucose, polyoxyethylated glycerol (POG), polyoxyalkylenes, polyethylene glycol propionaldehyde, copolymers of ethylene glycol/propylene glycol, monomethoxy-polyethylene glycol, mono-($C_1$-$C_{10}$) alkoxy- or aryloxy-polyethylene glycol, carboxymethylcellulose, polyacetals, polyvinyl alcohol (PVA), polyvinyl pyrrolidone, poly-1, 3-dioxolane, poly-1,3,6-trioxane, ethylene/maleic anhydride copolymer, poly (beta-amino acids) (either homopolymers or random copolymers), poly(n-vinyl pyrrolidone)polyethylene glycol, propropylene glycol homopolymers (PPG) and other polyakylene oxides, polypropylene oxide/ethylene oxide copolymers, colonic acids or other polysaccharide polymers, Ficoll or dextran and mixtures thereof.

The hydrophilic moiety, e.g., polyethylene glycol chain in accordance with some embodiments has a molecular weight selected from the range of about 500 to about 40,000 Daltons. In one embodiment the hydrophilic moiety, e.g. PEG, has a molecular weight selected from the range of about 500 to about 5,000 Daltons, or about 1,000 to about 5,000 Daltons. In another embodiment the hydrophilic moiety, e.g., PEG, has a molecular weight of about 10,000 to about 20,000 Daltons. In yet other exemplary embodiment the hydrophilic moiety, e.g., PEG, has a molecular weight of about 20,000 to about 40,000 Daltons. In one embodiment the hydrophilic moiety, e.g. PEG, has a molecular weight of about 20,000 Daltons. In one embodiment an insulin peptide is provided wherein one or more amino acids of the analog are pegylated, and the combined molecular weight of the covalently linked PEG chains is about 20,000 Daltons.

In one embodiment dextrans are used as the hydrophilic moiety. Dextrans are polysaccharide polymers of glucose subunits, predominantly linked by al-6 linkages. Dextran is available in many molecular weight ranges, e.g., about 1 kD to about 100 kD, or from about 5, 10, 15 or 20 kD to about 20, 30, 40, 50, 60, 70, 80 or 90 kD.

Linear or branched polymers are contemplated. Resulting preparations of conjugates may be essentially monodisperse or polydisperse, and may have about 0.5, 0.7, 1, 1.2, 1.5 or 2 polymer moieties per peptide.

In one embodiment the hydrophilic moiety is a polyethylene glycol (PEG) chain, optionally linked to the side chain of an amino acid at a position selected from the group consisting of A9, A14 and A15 of the A chain, positions B1, B2, B10, B22, B28 or B29 of the B chain, at the N-terminal alpha amine of the B chain, or at any position of the linking moiety of a single chain insulin analog that links the A chain and B chain, including for example at position C8. In one embodiment the single chain insulin analog comprises a peptide linking moiety of 8 to 12 amino acids, wherein one of the amino acids of the linking moiety has a polyethylene chain covalently bound to its side chain. In one embodiment the single chain insulin analog comprises a peptide linking moiety of 8 to 12 amino acids, wherein an amino acid of the linking moiety is pegylated and one or more amino acid at a position selected from the group consisting of A9, A14 and A15 of the A chain, positions B1, B2, B10, B22, B28 or B29 of the B chain is also pegylated. In one embodiment the total molecular weight of the covalently linked PEG chain(s) is about 20,000 Daltons.

In one embodiment a single chain insulin analog comprises a linking moiety of 8 to 12 amino acids, wherein one of the amino acids of the linking moiety has a 20,000 Dalton polyethylene chain covalently bound to its side chain. In another embodiment a insulin analog comprises a peptide linking moiety of 8 to 12 amino acids, wherein one of the amino acids of the linking moiety has a polyethylene chain covalently bound to its side chain and a second PEG chain is linked to the N-terminal alpha amine of the B chain (e.g. at position B1 for insulin based B chain or position B2 for IGF-1 based B chain) or at the side chain of an amino acid at position B1, B2 and B29 of the B chain. In one embodiment when two PEG chains are linked to the insulin peptide, each PEG chain has a molecular weight of about 10,000 Daltons. In one embodiment when the PEG chain is linked to an 8 to 12 amino acid linking moiety, the PEG chain is linked at position C7 or C8 of the linking moiety and in one embodiment the PEG chain is linked at position C8 of the linking moiety. In one embodiment when two PEG chains are linked to the single chain insulin analog, with one PEG chain linked at position C8 and the second PEG is linked at A9, A14, A15, B1, B2, B10, B22, B28 or B29.

Hydrophilic moieties such as polyethylene glycol can be attached to the glucagon related peptide-insulin conjugate under any suitable conditions used to react a protein with an activated polymer molecule. Any means known in the art can be used, including via acylation, reductive alkylation, Michael addition, thiol alkylation or other chemoselective conjugation/ligation methods through a reactive group on the PEG moiety (e.g., an aldehyde, amino, ester, thiol, α-haloacetyl, maleimido or hydrazino group) to a reactive group on the target compound (e.g., an aldehyde, amino, ester, thiol, α-haloacetyl, maleimido or hydrazino group). Activating groups which can be used to link the water soluble polymer to one or more proteins include without limitation sulfone, maleimide, sulfhydryl, thiol, triflate, tresylate, azidirine, oxirane and 5-pyridyl. If attached to the peptide by reductive alkylation, the polymer selected should have a single reactive aldehyde so that the degree of polymerization is controlled. See, for example, Kinstler et al., *Adv. Drug. Delivery Rev.* 54: 477-485 (2002); Roberts et al., *Adv. Drug Delivery Rev.* 54: 459-476 (2002); and Zalipsky et al., *Adv. Drug Delivery Rev.* 16: 157-182 (1995).

Acylation

In some embodiments, the insulin analog is modified to comprise an acyl group. The acyl group can be covalently linked directly to an amino acid of the glucagon related peptide-insulin conjugate, or indirectly to an amino acid of the glucagon related peptide-insulin conjugate via a spacer, wherein the spacer is positioned between the amino acid of the glucagon related peptide-insulin conjugate and the acyl group. The glucagon related peptide-insulin conjugate may be acylated at the same amino acid position where a hydrophilic moiety is linked, or at a different amino acid position. For example, acylation may occur at any position including any of amino acid of the A or B chains as well as a position within the linking moiety, provided that the activity exhibited by the non-acylated glucagon related peptide-insulin conjugate is retained upon acylation. Nonlimiting examples include acylation at positions A14 and A15 of the A chain, positions position B1 for insulin based B chain or position B2 for IGF-1 based B chain or positions B10, B22, B28 or B29 of the B chain or at any position of the linking moiety.

In one specific aspect of the invention, the insulin analog is modified to comprise an acyl group by direct acylation of an amine, hydroxyl, or thiol of a side chain of an amino acid of the glucagon related peptide-insulin conjugate. In some embodiments, the insulin analog is directly acylated through the side chain amine, hydroxyl, or thiol of an amino acid. In some embodiments, acylation is at position B28 or B29 (according to the amino acid numbering of the native insulin A and B chain sequences). In this regard, an insulin analog can be provided that has been modified by one or more amino acid substitutions in the A or B chain sequence, including for example at positions A14, A15, B1, B2, B10, B22, B28 or B29 (according to the amino acid numbering of the native insulin A and B chain sequences) or at any position of the linking moiety with an amino acid comprising a side chain amine, hydroxyl, or thiol. In some specific embodiments of the invention, the direct acylation of the insulin peptide occurs through the side chain amine, hydroxyl, or thiol of the amino acid at position B28 or B29 (according to the amino acid numbering of the native insulin A and B chain sequences).

In accordance with one embodiment, the acylated insulin analogs comprise a spacer between the peptide and the acyl group. In some embodiments, the glucagon related peptide-insulin conjugate is covalently bound to the spacer, which is covalently bound to the acyl group. In some exemplary embodiments, the insulin peptide is modified to comprise an acyl group by acylation of an amine, hydroxyl, or thiol of a spacer, which spacer is attached to a side chain of an amino acid at position B28 or B29 (according to the amino acid numbering of the A or B chain of native insulin), or at any position of the spacer moiety. The amino acid of the glucagon related peptide-insulin conjugate to which the spacer is attached can be any amino acid comprising a moiety which permits linkage to the spacer. For example, an amino acid comprising a side chain —NH$_2$, —OH, or —COOH (e.g., Lys, Orn, Ser, Asp, or Glu) is suitable.

In some embodiments, the spacer between the glucagon related peptide-insulin conjugate and the acyl group is an amino acid comprising a side chain amine, hydroxyl, or thiol (or a dipeptide or tripeptide comprising an amino acid comprising a side chain amine, hydroxyl, or thiol). In some embodiments, the spacer comprises a hydrophilic bifunctional spacer. In a specific embodiment, the spacer comprises an amino poly(alkyloxy)carboxylate. In this regard, the spacer can comprise, for example, NH$_2$(CH$_2$CH$_2$O)$_n$(CH$_2$)$_m$COOH, wherein m is any integer from 1 to 6 and n is any integer from 2 to 12, such as, e.g., 8-amino-3,6-dioxaoctanoic acid, which is commercially available from Peptides International, Inc. (Louisville, Ky.). In one embodiment, the hydrophilic bifunctional spacer comprises two or more reactive groups, e.g., an amine, a hydroxyl, a thiol, and a carboxyl group or any combinations thereof. In certain embodiments, the hydrophilic bifunctional spacer comprises a hydroxyl group and a carboxylate. In other embodiments, the hydrophilic bifunctional spacer comprises an amine group and a carboxylate. In other embodiments, the hydrophilic bifunctional spacer comprises a thiol group and a carboxylate.

In some embodiments, the spacer between peptide the glucagon related peptide-insulin conjugate and the acyl group is a hydrophobic bifunctional spacer. Hydrophobic bifunctional spacers are known in the art. See, e.g., Bioconjugate Techniques, G. T. Hermanson (Academic Press, San Diego, Calif., 1996), which is incorporated by reference in its entirety. In accordance with certain embodiments the bifunctional spacer can be a synthetic or naturally occurring amino acid comprising an amino acid backbone that is 3 to 10 atoms in length (e.g., 6-amino hexanoic acid, 5-aminovaleric acid, 7-aminoheptanoic acid, and 8-aminooctanoic acid). Alternatively, the spacer can be a dipeptide or tripeptide spacer having a peptide backbone that is 3 to 10 atoms (e.g., 6 to 10 atoms) in length. Each amino acid of the dipeptide or tripeptide spacer attached to the glucagon related peptide-insulin conjugate can be independently selected from the group consisting of: naturally-occurring and/or non-naturally occurring amino acids, including, for example, any of the D or L isomers of the naturally-occurring amino acids (Ala, Cys, Asp, Glu, Phe, Gly, His, Ile, Lys, Leu, Met, Asn, Pro, Arg, Ser, Thr, Val, Trp, Tyr), or any D or L isomers of the non-naturally occurring amino acids selected from the group consisting of: β-alanine (β-Ala), N-α-methyl-alanine (Me-Ala), aminobutyric acid (Abu), α-aminobutyric acid (γ-Abu), aminohexanoic acid (ε-Ahx), aminoisobutyric acid (Aib), aminomethylpyrrole carboxylic acid, aminopiperidinecarboxylic acid, aminoserine (Ams), aminotetrahydropyran-4-carboxylic acid, arginine N-methoxy-N-methyl amide, β-aspartic acid (β-Asp), azetidine carboxylic acid, 3-(2-benzothiazolyl)alanine, α-tert-butylglycine, 2-amino-5-ureido-n-valeric acid (citrulline, Cit), β-Cyclohexylalanine (Cha), acetamidomethyl-cysteine, diaminobutanoic acid (Dab), diaminopropionic acid (Dpr), dihydroxyphenylalanine (DOPA), dimethylthiazolidine (DMTA), γ-Glutamic acid (γ-Glu), homoserine (Hse), hydroxyproline (Hyp), isoleucine N-methoxy-N-methyl amide, methyl-isoleucine (MeIle), isonipecotic acid (Isn), methyl-leucine (MeLeu), methyl-lysine, dimethyl-lysine, trimethyl-lysine, methanoproline, methionine-sulfoxide (Met(O)), methionine-sulfone (Met(O2)), norleucine (Nle), methyl-norleucine (Me-Nle), norvaline (Nva), ornithine (Orn), para-aminobenzoic acid (PABA), penicillamine (Pen), methylphenylalanine (MePhe), 4-Chlorophenylalanine (Phe(4-C1)), 4-fluorophenylalanine (Phe(4-F)), 4-nitrophenylalanine (Phe(4-NO2)), 4-cyanophenylalanine ((Phe(4-CN)), phenylglycine (Phg), piperidinylalanine, piperidinylglycine, 3,4-dehydroproline, pyrrolidinylalanine, sarcosine (Sar), selenocysteine (Sec), U-Benzyl-phosphoserine, 4-amino-3-hydroxy-6-methylheptanoic acid (Sta), 4-amino-5-cyclohexyl-3-hydroxypentanoic acid (ACHPA), 4-amino-3-hydroxy-5-phenylpentanoic acid (AHPPA), 1,2,3,4,-tetrahydro-isoquinoline-3-carboxylic acid (Tic), tetrahydropyranglycine, thienylalanine (Thi), U-Benzyl-phosphotyrosine, O-Phosphotyrosine, methoxytyrosine, ethoxytyrosine, O-(bis-dimethylamino-phosphono)-tyrosine, tyrosine sulfate tetrabutylamine, methyl-valine (Me-Val), 1-amino-1-cyclohexane carboxylic acid (Acx), aminovaleric acid, beta-cyclopropyl-alanine (Cpa), propargylglycine (Prg), allylglycine (Alg), 2-amino-2-cyclohexyl-propanoic acid (2-Cha), tertbutylglycine (Tbg), vinylglycine (Vg), 1-amino-1-cyclopropane carboxylic acid (Acp), 1-amino-1-cyclopentane carboxylic acid (Acpe), alkylated 3-mercaptopropionic acid, 1-amino-1-cyclobutane carboxylic acid (Acb). In some embodiments the dipeptide spacer is selected from the group consisting of: Ala-Ala, β-Ala-β-Ala, Leu-Leu, Pro-Pro, γ-aminobutyric acid-γ-aminobutyric acid, and γ-Glu-γ-Glu.

The peptide the glucagon related peptide-insulin conjugate can be modified to comprise an acyl group by acylation of a long chain alkane of any size and can comprise any length of carbon chain. The long chain alkane can be linear or branched. In certain aspects, the long chain alkane is a $C_4$ to $C_{30}$ alkane. For example, the long chain alkane can be any of a $C_4$ alkane, $C_6$ alkane, $C_8$ alkane, $C_{10}$ alkane, $C_{12}$ alkane, $C_{14}$ alkane, $C_{16}$ alkane, $C_{18}$ alkane, $C_{20}$ alkane, $C_{22}$ alkane, $C_{24}$ alkane, $C_{26}$ alkane, $C_{28}$ alkane, or a $C_{30}$ alkane. In some embodiments, the long chain alkane comprises a $C_8$ to $C_{20}$ alkane, e.g., a $C_{14}$ alkane, $C_{16}$ alkane, or a $C_{18}$ alkane.

In some embodiments, an amine, hydroxyl, or thiol group of the glucagon related peptide-insulin conjugate is acylated with a cholesterol acid. In a specific embodiment, the peptide is linked to the cholesterol acid through an alkylated des-amino Cys spacer, i.e., an alkylated 3-mercaptopropionic acid spacer. Suitable methods of peptide acylation via amines, hydroxyls, and thiols are known in the art. See, for example, Miller, Biochem Biophys Res Commun 218: 377-382 (1996); Shimohigashi and Stammer, Int J Pept Protein Res 19: 54-62 (1982); and Previero et al., Biochim Biophys Acta 263: 7-13 (1972) (for methods of acylating through a hydroxyl); and San and Silvius, J Pept Res 66: 169-180 (2005) (for methods of acylating through a thiol); Bioconjugate Chem. "Chemical Modifications of Proteins: History and Applications" pages 1, 2-12 (1990); Hashimoto et al., Pharmacuetical Res. "Synthesis of Palmitoyl Derivatives of Insulin and their Biological Activity" Vol. 6, No: 2 pp. 171-176 (1989).

The acyl group of the acylated peptide the glucagon related peptide-insulin conjugate can be of any size, e.g., any length carbon chain, and can be linear or branched. In some specific embodiments of the invention, the acyl group is a $C_4$ to $C_{30}$ fatty acid. For example, the acyl group can be any of a $C_4$ fatty acid, $C_6$ fatty acid, $C_8$ fatty acid, $C_{10}$ fatty acid, $C_{12}$ fatty acid, $C_{14}$ fatty acid, $C_{16}$ fatty acid, $C_{18}$ fatty acid, $C_{20}$ fatty acid, $C_{22}$ fatty acid, $C_{24}$ fatty acid, $C_{26}$ fatty acid, $C_{28}$ fatty acid, or a $C_{30}$ fatty acid. In some embodiments, the acyl group is a $C_8$ to $C_{20}$ fatty acid, e.g., a $C_{14}$ fatty acid or a $C_{16}$ fatty acid.

In an alternative embodiment, the acyl group is a bile acid. The bile acid can be any suitable bile acid, including, but not limited to, cholic acid, chenodeoxycholic acid, deoxycholic acid, lithocholic acid, taurocholic acid, glycocholic acid, and cholesterol acid.

Alkylation

In some embodiments, the glucagon related peptide-insulin conjugate is modified to comprise an alkyl group. The alkyl group can be covalently linked directly to an amino acid of the insulin analog, or indirectly to an amino acid of the glucagon related peptide-insulin conjugate via a spacer, wherein the spacer is positioned between the amino acid of the glucagon related peptide-insulin conjugate and the alkyl group. The alkyl group can be attached to the glucagon related peptide-insulin conjugate via an ether, thioether, or amino linkage. For example, the glucagon related peptide-insulin conjugate may be alkylated at the same amino acid position where a hydrophilic moiety is linked, or at a different amino acid position. Alkylation can be carried out at any position within the glucagon related peptide-insulin conjugate, including for example in the C-terminal region of the B chain or at a position in the linking moiety, provided that insulin activity is retained. In a specific aspect of the invention, the glucagon related peptide-insulin conjugate is modified to comprise an alkyl group by direct alkylation of an amine, hydroxyl, or thiol of a side chain of an amino acid of the glucagon related peptide-insulin conjugate. In some embodiments, the glucagon related peptide-insulin conjugate is directly alkylated through the side chain amine, hydroxyl, or thiol of an amino acid. In some specific embodiments of the invention, the direct alkylation of the glucagon related peptide-insulin conjugate occurs through the side chain amine, hydroxyl, or thiol of the amino acid at position A14, A15, B1 (for insulin based B chains), B2 (for IGF-1 based B chains), B10, B22, B28 or B29 (according to the amino acid numbering of the A and B chain of native insulin).

In some embodiments of the invention, the glucagon related peptide-insulin conjugate comprises a spacer between the peptide and the alkyl group. In some embodiments, the glucagon related peptide-insulin conjugate is covalently bound to the spacer, which is covalently bound to the alkyl group. In some exemplary embodiments, the glucagon related peptide-insulin conjugate is modified to comprise an alkyl group by alkylation of an amine, hydroxyl, or thiol of a spacer, wherein the spacer is attached to a side chain of an amino acid at position A14, A15, B1 (for insulin based B chains), B2 (for IGF-1 based B chains), B10, B22, B28 or B29 (according to the amino acid numbering of the A and B chains of native insulin). The amino acid of the glucagon related peptide-insulin conjugate to which the spacer is attached can be any amino acid (e.g., a singly α-substituted amino acid or an α,α-disubstituted amino acid) comprising a moiety which permits linkage to the spacer. An amino acid of the glucagon related peptide-insulin conjugate comprising a side chain —NH$_2$, —OH, or —COOH (e.g., Lys, Orn, Ser, Asp, or Glu) is suitable. In some embodiments, the spacer between the peptide the glucagon related peptide-insulin conjugate and the alkyl group is an amino acid comprising a side chain amine, hydroxyl, or thiol or a dipeptide or tripeptide comprising an amino acid comprising a side chain amine, hydroxyl, or thiol.

In the instance in which the alpha amine is alkylated, the spacer amino acid can be any amino acid. For example, the spacer amino acid can be a hydrophobic amino acid, e.g., Gly, Ala, Val, Leu, Ile, Trp, Met, Phe, Tyr. Alternatively, the spacer amino acid can be an acidic residue, e.g., Asp and Glu. In exemplary embodiments, the spacer amino acid can be a hydrophobic amino acid, e.g., Gly, Ala, Val, Leu, Ile, Trp, Met, Phe, Tyr, 6-amino hexanoic acid, 5-aminovaleric acid, 7-aminoheptanoic acid, 8-aminooctanoic acid. Alternatively, the spacer amino acid can be an acidic residue, e.g., Asp and Glu, provided that the alkylation occurs on the alpha amine of the acidic residue. In the instance in which the side chain amine of the spacer amino acid is alkylated, the spacer amino acid is an amino acid comprising a side chain amine, e.g., an amino acid of Formula I (e.g., Lys or Orn). In this instance, it is possible for both the alpha amine and the side chain amine of the spacer amino acid to be alkylated, such that the peptide is dialkylated. Embodiments of the invention include such dialkylated molecules.

In some embodiments, the spacer comprises a hydrophilic bifunctional spacer. In a specific embodiment, the spacer comprises an amino poly(alkyloxy)carboxylate. In this regard, the spacer can comprise, for example, NH$_2$(CH$_2$CH$_2$O)$_n$(CH$_2$)$_m$COOH, wherein m is any integer from 1 to 6 and n is any integer from 2 to 12, such as, e.g., 8-amino-3,6-dioxaoctanoic acid, which is commercially available from Peptides International, Inc. (Louisville, Ky.). In some embodiments, the spacer between peptide the glucagon related peptide-insulin conjugate and the alkyl group is a hydrophilic bifunctional spacer. In certain embodiments, the hydrophilic bifunctional spacer comprises two or more reactive groups, e.g., an amine, a hydroxyl, a thiol, and a carboxyl group or any combinations thereof. In certain embodiments, the hydrophilic bifunctional spacer comprises a hydroxyl group and a carboxylate. In other embodiments, the hydrophilic bifunctional spacer comprises an amine group and a carboxylate. In other embodiments, the hydrophilic bifunctional spacer comprises a thiol group and a carboxylate.

The spacer (e.g., amino acid, dipeptide, tripeptide, hydrophilic bifunctional spacer, or hydrophobic bifunctional spacer) is 3 to 10 atoms (e.g., 6 to 10 atoms, (e.g., 6, 7, 8, 9, or 10 atoms)) in length. In more specific embodiments, the spacer is about 3 to 10 atoms (e.g., 6 to 10 atoms) in length and the alkyl is a $C_{12}$ to $C_{18}$ alkyl group, e.g., $C_{14}$ alkyl group, $C_{16}$ alkyl group, such that the total length of the spacer and alkyl group is 14 to 28 atoms, e.g., about 14, 15, 16, 17, 18, 19, 20, 21, 22, 23, 24, 25, 26, 27, or 28 atoms. In some embodiments the length of the spacer and alkyl is 17 to 28 (e.g., 19 to 26, 19 to 21) atoms.

In accordance with one embodiment the bifunctional spacer is a synthetic or non-naturally occurring amino acid comprising an amino acid backbone that is 3 to 10 atoms in length (e.g., 6-amino hexanoic acid, 5-aminovaleric acid, 7-aminoheptanoic acid, and 8-aminooctanoic acid). Alternatively, the spacer can be a dipeptide or tripeptide spacer having a peptide backbone that is 3 to 10 atoms (e.g., 6 to 10 atoms) in length. The dipeptide or tripeptide spacer attached to the glucagon related peptide-insulin conjugate can be composed of naturally-occurring and/or non-naturally occurring amino acids, including, for example, any of the amino acids taught herein. In some embodiments the spacer comprises an overall negative charge, e.g., comprises one or two negatively charged amino acids. In some embodiments the dipeptide spacer is selected from the group consisting of: Ala-Ala, β-Ala-β-Ala, Leu-Leu, Pro-Pro, γ-aminobutyric acid-γ-aminobutyric acid, and γ-Glu-γ-Glu. In one embodiment the dipeptide spacer is γ-Glu-γ-Glu.

Suitable methods of peptide alkylation via amines, hydroxyls, and thiols are known in the art. For example, a Williamson ether synthesis can be used to form an ether linkage between the insulin peptide and the alkyl group. Also, a nucleophilic substitution reaction of the peptide with an alkyl halide can result in any of an ether, thioether, or amino linkage. The alkyl group of the alkylated peptide the glucagon related peptide-insulin conjugate can be of any size, e.g., any length carbon chain, and can be linear or branched. In some embodiments of the invention, the alkyl group is a $C_4$ to $C_{30}$ alkyl. For example, the alkyl group can be any of a $C_4$ alkyl, $C_6$ alkyl, $C_8$ alkyl, $C_{10}$ alkyl, $C_{12}$ alkyl, $C_{14}$ alkyl, $C_{16}$ alkyl, $C_{18}$ alkyl, $C_{20}$ alkyl, $C_{22}$ alkyl, $C_{24}$ alkyl, $C_{26}$ alkyl, $C_{28}$ alkyl, or a $C_{30}$ alkyl. In some embodiments, the alkyl group is a $C_8$ to $C_{20}$ alkyl, e.g., a $C_{14}$ alkyl or a $C_{16}$ alkyl.

In some specific embodiments, the alkyl group comprises a steroid moiety of a bile acid, e.g., cholic acid, chenodeoxycholic acid, deoxycholic acid, lithocholic acid, taurocholic acid, glycocholic acid, and cholesterol acid.

When a long chain alkane is alkylated by the glucagon related peptide-insulin conjugate or the spacer, the long chain alkane may be of any size and can comprise any length of carbon chain. The long chain alkane can be linear or branched. In certain aspects, the long chain alkane is a $C_4$ to $C_{30}$ alkane. For example, the long chain alkane can be any of a $C_4$ alkane, $C_6$ alkane, $C_8$ alkane, $C_{10}$ alkane, $C_{12}$ alkane, $C_{14}$ alkane, $C_{16}$ alkane, $C_{18}$ alkane, $C_{20}$ alkane, $C_{22}$ alkane, $C_{24}$ alkane, $C_{26}$ alkane, $C_{28}$ alkane, or a $C_{30}$ alkane. In some embodiments the long chain alkane comprises a $C_8$ to $C_{20}$ alkane, e.g., a $C_{14}$ alkane, $C_{16}$ alkane, or a $C_{18}$ alkane.

Also, in some embodiments alkylation can occur between the insulin analog and a cholesterol moiety. For example, the hydroxyl group of cholesterol can displace a leaving group on the long chain alkane to form a cholesterol-insulin peptide product.

Controlled Release Formulations

Alternatively, the insulin/incretin conjugates described herein can be modified into a depot form, such that the manner in which the conjugate of the present disclosure is released into the body to which it is administered is controlled with respect to time and location within the body (see, for example, U.S. Pat. No. 4,450,150). Depot forms of the conjugates of the present disclosures can be, for example, an implantable composition comprising the conjugate of the present disclosure and a porous or non-porous material, such as a polymer, wherein the conjugate of the present disclosures is encapsulated by or diffused throughout the material and/or degradation of the non-porous material. The depot is then implanted into the desired location within the body and the conjugate of the present disclosures are released from the implant at a predetermined rate.

Alternatively, a large depot polymer can be linked to a self cleaving dipeptide element that is covalently bound to the conjugate as described herein. In this embodiment, the depot polymer effectively sequesters the glucagon related peptide-insulin conjugate at its site of administration until it is subsequently cleaved from the single chain analog via a non-enzymatic reaction at a predetermined rate. Depot formulations of insulin analogs using a self cleaving dipeptide have been described in published international application no. WO 2010/080607, the disclosure of which is incorporated herein. In one embodiment a glucagon related peptide-insulin conjugate is provided comprising a dipeptide prodrug element wherein the dipeptide prodrug element is linked to a large polymer such as PEG or dextran. In one embodiment a self cleaving dipeptide element comprising a large depot polymer (including for example, PEG) is linked to the side chain of an amino acid of the linking moiety, including for example, the amino acid at position C8 of the linking moiety.

Pharmaceutical compositions can be prepared that comprise the single chain analogs and are formulated to have a desired in vivo release profile. In some aspects, the pharmaceutical composition is an immediate release, controlled release, sustained release, extended release, delayed release, or bi-phasic release formulation. Methods of formulating peptides or conjugates for controlled release are known in the art. See, for example, J Pharm 374: 46-52 (2009) and International Patent Application Publication Nos. WO 2008/130158, WO2004/033036; WO2000/032218; and WO 1999/040942. The instant compositions may further comprise, for example, micelles or liposomes, or some other encapsulated form, or may be administered in an extended release form to provide a prolonged storage and/or delivery effect. The disclosed pharmaceutical formulations may be administered according to any regime including, for example, daily (1 time per day, 2 times per day, 3 times per day, 4 times per day, 5 times per day, 6 times per day), every two days, every three days, every four days, every five days, every six days, weekly, bi-weekly, every three weeks, monthly, or bi-monthly.

In accordance with one embodiment the depot polymer is selected from biocompatible polymers known to those skilled in the art. The depot polymers typically have a size selected from a range of about 20,000 to 120,000 Daltons. In one embodiment the depot polymer has a size selected from a range of about 40,000 to 100,000 or about 40,000 to 80,000 Daltons. In one embodiment the depot polymer has a size of about 40,000, 50,000, 60,000, 70,000 or 80,000 Daltons. Suitable depot polymers include but are not limited to dextrans, polylactides, polyglycolides, caprolactone-based polymers, poly(caprolactone), polyanhydrides, polyamines, polyesteramides, polyorthoesters, polydioxanones, polyacetals, polyketals, polycarbonates, polyphosphoesters, polyesters, polybutylene terephthalate, polyorthocarbonates, polyphosphazenes, succinates, poly(malic acid), poly(amino acids), polyvinylpyrrolidone, polyethylene glycol, polyhydroxycellulose, polysaccharides, chitin, chitosan, hyaluronic acid, and copolymers, terpolymers and mixtures thereof, and biodegradable polymers and their copolymers including caprolactone-based polymers, polycaprolactones and copolymers which include polybutylene terephthalate. In one embodiment the depot polymer is selected from the group consisting of polyethylene glycol, dextran, polylactic acid, polyglycolic acid and a copolymer of lactic acid and glycolic acid, and in one specific embodiment the depot polymer is polyethylene glycol. In one embodiment the depot polymer is polyethylene glycol and the combined molecular weight of depot polymer(s) linked to the dipeptide element is about 40,000 to 80,000 Daltons.

In accordance with one embodiment a self cleaving dipeptide element is provided, comprising the structure U-J, wherein U is an amino acid or a hydroxy acid and J is an N-alkylated amino acid. In one embodiment one or more dipeptide elements are linked to the glucagon related peptide-insulin conjugate through an amide bond formed through one or more amino groups selected from the N-terminal amino group of the B chain of the insulin component, the N-terminus of the glucagon related peptide component, or the side chain amino group of an amino acid present in the conjugate. In accordance with one embodiment one or more dipeptide elements are linked to the glucagon related peptide-insulin conjugate at an amino group selected from the N-terminal amino group of the conjugate, or the side chain amino group of an aromatic amine of a 4-amino-phenylalanine residue present at a position corresponding to position A19, B16 or B25 of native insulin, or a side chain of an amino acid of the linking moiety of a single chain insulin analog, or the N-terminus of the glucagon related peptide or insulin peptide components of the conjugate.

In one embodiment the dipeptide prodrug element comprises the general structure of Formula X:

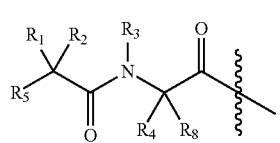

X wherein $R_1$, $R_2$, $R_4$ and $R_8$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl (W)$C_1$-$C_{12}$ alkyl, wherein W is a heteroatom selected from the group consisting of N, S and O, or $R_1$ and $R_2$ together with the atoms to which they are attached form a $C_3$-$C_{12}$ cycloalkyl or aryl; or $R_4$ and $R_8$ together with the atoms to which they are attached form a $C_3$-$C_6$ cycloalkyl;

$R_3$ is selected from the group consisting of $C_1$-$C_{18}$ alkyl, ($C_1$-$C_{18}$ alkyl)OH, ($C_1$-$C_{18}$ alkyl)NH$_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl) ($C_3$-$C_9$ heteroaryl) or $R_4$ and $R_3$ together with the atoms to which they are attached form a 4, 5 or 6 member heterocyclic ring;

$R_5$ is NHR$_6$ or OH;

$R_6$ is H, $C_1$-$C_8$ alkyl or $R_6$ and $R_2$ together with the atoms to which they are attached form a 4, 5 or 6 member heterocyclic ring; and $R_7$ is selected from the group consisting of H and OH. In one embodiment when the prodrug element is linked to the N-terminal amine of the glucagon related peptide-insulin conjugate and $R_4$ and $R_3$ together with the atoms to which they are attached form a 4, 5 or 6 member heterocyclic ring, then at least one of $R_1$ and $R_2$ are other than H.

Glucagon Related Peptides

Applicants have discovered analogs of glucagon that have altered activities at the glucagon, GLP1 and GIP receptors. Any of these analogs can be used as the glucagon related peptide in the conjugates described herein. More particularly the glucagon related peptide can be any of the class 1, class 2 or class 3 glucagon peptides described herein.

Class 1 Glucagon Related Peptides

In certain embodiments, the glucagon related peptide is a Class 1 glucagon related peptide, which is described herein and in International Patent Application No. PCT US2009/47437 (filed on Jun. 16, 2009) and International Patent Application Publication No. WO 2008/086086, published on Jul. 17, 2008, the contents of which are incorporated by reference in their entirety.

The biological sequences referenced in the following section (SEQ ID NOs: 801-915) relating to Class 1 glucagon related peptides correspond to SEQ ID NOs: 1-115 in International Patent Application No. PCT US2009/47437.

Activity

Class 1 glucagon related peptides retain glucagon receptor activity relative to the native glucagon peptide (SEQ ID NO: 801). For example, the glucagon related peptide can retain at least 10%, 20%, 30%, 40%, 50%, 60%, 70%, 75% activity, 80% activity, 85% activity, or 90% of the activity of native glucagon (calculated as the inverse ratio of EC50s for the glucagon related peptide vs. glucagon, e.g., as measured by cAMP production using the assay generally described in Example 7). In some embodiments, the Class 1 glucagon related peptides have the same or greater activity (used synonymously with the term "potency" herein) than glucagon. In some embodiments, the glucagon related peptides described herein exhibit no more than about 100%, 1000%, 10,000%, 100,000%, or 1,000,000% of the activity of native glucagon peptide.

Improved Solubility

Native glucagon exhibits poor solubility in aqueous solution, particularly at physiological pH, with a tendency to aggregate and precipitate over time. In contrast, the Class 1 glucagon related peptides in some embodiments exhibit at least 2-fold, 5-fold, or even higher solubility compared to native glucagon at a pH between 6 and 8, or between 6 and 9, for example, at pH 7 after 24 hours at 25° C.

Accordingly, in some embodiments, a Class 1 glucagon related peptide has been modified relative to the wild type peptide of His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asn-Thr (SEQ ID NO: 801) to improve the peptide's solubility in aqueous solutions, particularly at a pH ranging from about 5.5 to about 8.0, while retaining the native peptide's biological activity.

For example, the solubility of any of the Class 1 glucagon related peptides described herein can be further improved by attaching a hydrophilic moiety to the peptide. Introduction of such groups also increases duration of action, e.g. as measured by a prolonged half-life in circulation. Hydrophilic moieties are further described herein.

Modification with Charged Residues

In some embodiments, solubility is improved by adding charge to the Class 1 glucagon related peptide by the substitution of native non-charged amino acids with charged amino acids selected from the group consisting of lysine, arginine, histidine, aspartic acid and glutamic acid, or by the addition of charged amino acids to the amino or carboxy terminus of the peptide.

In accordance with some embodiments, the Class 1 glucagon related peptide has improved solubility due to the fact that the peptide is modified by amino acid substitutions and/or additions that introduce a charged amino acid into the C-terminal portion of the peptide, and in some embodiments at a position C-terminal to position 27 of SEQ ID NO: 801. Optionally, one, two or three charged amino acids may be introduced within the C-terminal portion, and in some embodiments C-terminal to position 27. In accordance with some embodiments, the native amino acid(s) at positions 28 and/or 29 are substituted with a charged amino acid, and/or one to three charged amino acids are added to the C-terminus of the peptide, e.g. after position 27, 28 or 29. In exemplary embodiments, one, two, three or all of the charged amino acids are negatively charged. In other embodiments, one, two, three or all of the charged amino acids are positively charged.

In specific exemplary embodiments, the Class 1 glucagon related peptide may comprise any one or two of the following modifications: substitution of N28 with E; substitution of N28 with D; substitution of T29 with D; substitution of T29 with E; insertion of E after position 27, 28 or 29; insertion of D after position 27, 28 or 29. For example, D28E29, E28E29, E29E30, E28E30, D28E30.

In accordance with one exemplary embodiment, the Class 1 glucagon related peptide comprises an amino acid sequence of SEQ ID NO: 811, or an analog thereof that contains 1 to 3 further amino acid modifications (described herein in reference to glucagon agonists) relative to native glucagon, or a glucagon agonist analog thereof. SEQ ID NO: 811 represents a modified Class 1 glucagon related peptide, wherein the asparagine residue at position 28 of the native protein has been substituted with an aspartic acid. In another exemplary embodiment the Class 1 glucagon related peptide comprises an amino acid sequence of SEQ ID NO: 838, wherein the asparagine residue at position 28 of the native protein has been substituted with glutamic acid. Other exemplary embodiments include Class 1 glucagon related peptides of SEQ ID NOS: 824, 825, 826, 833, 835, 836 and 837.

Improved Stability

Any of the Class 1 glucagon related peptides may additionally exhibit improved stability and/or reduced degradation, for example, retaining at least 95% of the original peptide after 24 hours at 25° C. The Class 1 glucagon related peptides may include additional modifications that alter its pharmaceutical properties, e.g. increased potency, prolonged half-life in circulation, increased shelf-life, reduced precipitation or aggregation, and/or reduced degradation, e.g., reduced occurrence of cleavage or chemical modification after storage.

In yet further exemplary embodiments, any of the foregoing Class 1 glucagon related peptides can be further modified to improve stability by modifying the amino acid at position 15 of SEQ ID NO: 801 to reduce degradation of the peptide over time, especially in acidic or alkaline buffers. In exemplary embodiments, Asp at position 15 is substituted with a Glu, homo-Glu, cysteic acid, or homo-cysteic acid.

Alternatively, any of the Class 1 glucagon related peptides described herein can be further modified to improve stability by modifying the amino acid at position 16 of SEQ ID NO: 801. In exemplary embodiments, Ser at position 16 is substituted with Thr or AIB, or any of the amino acids substitutions described herein with regard to Class 1 glucagon related peptides which enhance potency at the glucagon receptor. Such modifications reduce cleavage of the peptide bond between Asp15-Ser16.

In some embodiments, any of the Class 1 glucagon related peptides described herein can be further modified to reduce degradation at various amino acid positions by modifying any one, two, three, or all four of positions 20, 21, 24, or 27. Exemplary embodiments include substitution of Gln at position 20 with Ser, Thr, Ala or AIB, substitution of Asp at position 21 with Glu, substitution of Gln at position 24 with Ala or AIB, substitution of Met at position 27 with Leu or Nle. Removal or substitution of methionine reduces degradation due to oxidation of the methionine. Removal or substitution of Gln or Asn reduces degradation due to deamidation of Gln or Asn. Removal or substitution of Asp reduces degradation that occurs through dehydration of Asp to form a cyclic succinimide intermediate followed by isomerization to iso-aspartate.

Enhanced Potency

In accordance with another embodiment, Class 1 glucagon related peptides are provided that have enhanced potency at the glucagon receptor, wherein the peptides comprise an amino acid modification at position 16 of native glucagon (SEQ ID NO: 801). By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homo-cysteic acid, or a charged amino acid having a side chain containing at least one heteroatom, (e.g. N, O, S, P) and with a side chain length of about 4 (or 3-5) atoms. Substitution of serine at position 16 with glutamic acid enhances glucagon activity at least 2-fold, 4-fold, 5-fold and up to 10-fold greater at the glucagon receptor. In some embodiments, the Class 1 glucagon related peptide retains selectivity for the glucagon receptor relative to the GLP-1 receptors, e.g., at least 5-fold, 10-fold, or 15-fold selectivity.

DPP-IV Resistance

In some embodiments, the Class 1 glucagon related peptides disclosed herein are further modified at position 1 or 2 to reduce susceptibility to cleavage by dipeptidyl peptidase IV. More particularly, in some embodiments, position 1 and/or position 2 of the Class 1 glucagon related peptide is substituted with the DPP-IV resistant amino acid(s) described herein. In some embodiments, position 2 of the analog peptide is substituted with an amino isobutyric acid. In some embodiments, position 2 of the analog peptide is substituted with an amino acid selected from the group consisting of D-serine, D-alanine, glycine, N-methyl serine, and ε-amino butyric acid. In another embodiment, position 2 of the Class 1 glucagon related peptide is substituted with an amino acid selected from the group consisting of D-serine, glycine, and aminoisobutyric acid. In some embodiments, the amino acid at position 2 is not D-serine.

Reduction in glucagon activity upon modification of the amino acids at position 1 and/or position 2 of the glucagon related peptide can be restored by stabilization of the alpha-helix structure in the C-terminal portion of the glucagon related peptide (around amino acids 12-29). The alpha helix structure can be stabilized by, e.g., formation of a covalent or non-covalent intramolecular bridge (e.g., a lactam bridge between side chains of amino acids at positions "i" and "i+4", wherein i is an integer from 12 to 25), substitution and/or insertion of amino acids around positions 12-29 with an alpha helix-stabilizing amino acid (e.g., an α,α-disubstituted amino acid), as further described herein.

Modifications at Position 3

Glucagon receptor activity can be reduced by an amino acid modification at position 3 (according to the amino acid numbering of wild type glucagon), e.g. substitution of the naturally occurring glutamine at position 3, with an acidic, basic, or a hydrophobic amino acid. For example substitution at position 3 with glutamic acid, ornithine, or norleucine substantially reduces or destroys glucagon receptor activity.

Maintained or enhanced activity at the glucagon receptor may be achieved by modifying the Gln at position 3 with a glutamine analog as described herein. For example, glucagon agonists can comprise the amino acid sequence of SEQ ID NO: 863, SEQ ID NO: 869, SEQ ID NO: 870, SEQ ID NO: 871, SEQ ID NO: 872, SEQ ID NO: 873 and SEQ ID NO: 874.

Enhancing GLP-1 Activity with C-Terminal Amides and Esters

Enhanced activity at the GLP-1 receptor is provided by replacing the carboxylic acid of the C-terminal amino acid with a charge-neutral group, such as an amide or ester. Conversely, retaining the native carboxylic acid at the C-terminus of the peptide maintains the relatively greater selectivity of the Class 1 glucagon related peptide for the glucagon receptor vs. the GLP-1 receptor (e.g., greater than about 5, 6, 7, 8, 9, 10, 11, 12, 13, 14, 15, 16, 17, 18, 19, or 20-fold).

Further Modifications and Combinations

Additional modifications may be made to the Class 1 glucagon related peptide which may further increase solubility and/or stability and/or glucagon activity. The Class 1 glucagon related peptide may alternatively comprise other modifications that do not substantially affect solubility or stability, and that do not substantially decrease glucagon activity. In exemplary embodiments, the Class 1 glucagon related peptide may comprise a total of up to 11, or up to 12, or up to 13, or up to 14 amino acid modifications relative to the native glucagon sequence. For example, conservative or non-conservative substitutions, additions or deletions may be carried out at any of positions 2, 5, 7, 10, 11, 12, 13, 14, 17, 18, 19, 20, 21, 24, 27, 28 or 29.

Exemplary modifications of the Class 1 glucagon related peptide include but are not limited to:

(a) non-conservative substitutions, conservative substitutions, additions or deletions while retaining at least partial glucagon agonist activity, for example, conservative substitutions at one or more of positions 2, 5, 7, 10, 11, 12, 13, 14, 16, 17, 18, 19, 20, 21, 24, 27, 28 or 29, substitution of Tyr at position 10 with Val or Phe, substitution of Lys at position 12 with Arg, substitution of one or more of these positions with Ala;

(b) deletion of amino acids at positions 29 and/or 28, and optionally position 27, while retaining at least partial glucagon agonist activity;

(c) modification of the aspartic acid at position 15, for example, by substitution with glutamic acid, homoglutamic acid, cysteic acid or homocysteic acid, which may reduce degradation; or modification of the serine at position 16, for example, by substitution of threonine, AIB, glutamic acid or with another negatively charged amino acid having a side chain with a length of 4 atoms, or alternatively with any one of glutamine, homoglutamic acid, or homocysteic acid, which likewise may reduce degradation due to cleavage of the Asp15-Ser16 bond;

(d) addition of a hydrophilic moiety such as the water soluble polymer polyethylene glycol, as described herein, e.g. at position 16, 17, 20, 21, 24, 29, 40 or at the C-terminal amino acid, which may increase solubility and/or half-life;

(e) modification of the methionine at position 27, for example, by substitution with leucine or norleucine, to reduce oxidative degradation;

(f) modification of the Gln at position 20 or 24, e.g. by substitution with Ser, Thr, Ala or AIB, to reduce degradation that occurs through deamidation of Gln (g) modification of Asp at position 21, e.g. by substitution with Glu, to reduce degradation that occurs through dehydration of Asp to form a cyclic succinimide intermediate followed by isomerization to iso-aspartate;

(h) modifications at position 1 or 2 as described herein that improve resistance to DPP-IV cleavage, optionally in combination with an intramolecular bridge such as a lactam bridge between positions "i" and "i+4", wherein i is an integer from 12 to 25, e.g., 12, 16, 20, 24;

(i) acylating or alkylating the glucagon related peptide as described herein, which may increase the activity at the glucagon receptor and/or the GLP-1 receptor, increase half-life in circulation and/or extending the duration of action and/or delaying the onset of action, optionally combined with addition of a hydrophilic moiety, additionally or alternatively, optionally combined with a modification which selectively reduces activity at the GLP-1 peptide, e.g., a modification of the Thr at position 7, such as a substitution of the Thr at position 7 with an amino acid lacking a hydroxyl group, e.g., Abu or Ile; deleting amino acids C-terminal to the amino acid at position 27 (e.g., deleting one or both of the amino acids at positions 28 and 29, yielding a peptide 27 or 28 amino acids in length);

(j) C-terminal extensions as described herein;

(k) homodimerization or heterodimerization as described herein; and combinations of the (a) through (k).

In some embodiments, exemplary modifications of the Class 1 glucagon related peptide include at least one amino acid modification selected from Group A and one or more amino acid modifications selected from Group B and/or Group C, wherein Group A is:

substitution of Asn at position 28 with a charged amino acid;

substitution of Asn at position 28 with a charged amino acid selected from the group consisting of Lys, Arg, His, Asp, Glu, cysteic acid, and homocysteic acid;

substitution at position 28 with Asn, Asp, or Glu;

substitution at position 28 with Asp;

substitution at position 28 with Glu;

substitution of Thr at position 29 with a charged amino acid;

substitution of Thr at position 29 with a charged amino acid selected from the group consisting of Lys, Arg, His, Asp, Glu, cysteic acid, and homocysteic acid;

substitution at position 29 with Asp, Glu, or Lys;

substitution at position 29 with Glu;

insertion of 1-3 charged amino acids after position 29;

insertion after position 29 of Glu or Lys;

insertion after position 29 of Gly-Lys or Lys-Lys;

or combinations thereof;

wherein Group B is:

substitution of Asp at position 15 with Glu;

substitution of Ser at position 16 with Thr or AIB;

and wherein Group C is:

substitution of His at position 1 with a non-native amino acid that reduces susceptibility of the glucagon related peptide to cleavage by dipeptidyl peptidase IV (DPP-IV), substitution of Ser at position 2 with a non-native amino acid that reduces susceptibility of the glucagon related peptide to cleavage by dipeptidyl peptidase IV (DPP-IV), substitution of Lys at position 12 with Arg;

substitution of Gln at position 20 with Ser, Thr, Ala or AIB;

substitution of Asp at position 21 with Glu;

substitution of Gln at position 24 with Ser, Thr, Ala or AIB;

substitution of Met at position 27 with Leu or Nle;

deletion of amino acids at positions 27-29;

deletion of amino acids at positions 28-29;

deletion of the amino acid at positions 29;

or combinations thereof.

In exemplary embodiments, Lys at position 12 is substituted with Arg. In other exemplary embodiments amino acids at positions 29 and/or 28, and optionally at position 27, are deleted.

In some specific embodiments, the glucagon related peptide comprises (a) an amino acid modification at position 1 and/or 2 that confers DPP-IV resistance, e.g., substitution with DMIA at position 1, or AIB at position 2, (b) an intramolecular bridge within positions 12-29, e.g. at positions 16 and 20, or one or more substitutions of the amino acids at positions 16, 20, 21, and 24 with an α,α disubstituted amino acid, optionally (c) linked to a hydrophilic moiety such as PEG, e.g., through Cys at position 24, 29 or at the C-terminal amino acid, optionally (d) an amino acid modification at position 27 that substitutes Met with, e.g., Nle, optionally (e) amino acid modifications at positions 20, 21 and 24 that reduce degradation, and optionally (f) linked to SEQ ID NO: 820. When the glucagon related peptide is linked to SEQ ID NO: 820, the amino acid at position 29 in certain embodiments is Thr or Gly. In other specific embodiments, the glucagon related peptide comprises (a) Asp28Glu29, or Glu28Glu29, or Glu29Glu30, or Glu28Glu30 or Asp28Glu30, and optionally (b) an amino acid modification at position 16 that substitutes Ser with, e.g. Thr or AIB, and optionally (c) an amino acid modification at position 27 that substitutes Met with, e.g., Nle, and optionally (d) amino acid modifications at positions 20, 21 and 24 that reduce degradation. In a specific embodiment, the glucagon related peptide is T16, A20, E21, A24, Nle27, D28, E29.

In some embodiments, the Class 1 glucagon related peptide comprises the amino acid sequence:
X1-X2-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Z (SEQ ID NO: 839) with 1 to 3 amino acid modifications thereto,
wherein X1 and/or X2 is a non-native amino acid that reduces susceptibility of (or increases resistance of) the glucagon related peptide to cleavage by dipeptidyl peptidase IV (DPP-IV), wherein Z is selected from the group consisting of —COOH (the naturally occurring C-terminal carboxylate), -Asn-COOH, Asn-Thr-COOH, and Y—COOH, wherein Y is 1 to 2 amino acids, and wherein an intramolecular bridge, preferably a covalent bond, connects the side chains of an amino acid at position i and an amino acid at position i+4, wherein i is 12, 16, 20 or 24.

In some embodiments, the intramolecular bridge is a lactam bridge. In some embodiments, the amino acids at positions i and i+4 of SEQ ID NO: 839 are Lys and Glu, e.g., Glu16 and Lys20. In some embodiments, X1 is selected from the group consisting of: D-His, N-methyl-His, alpha-methyl-His, imidazole acetic acid, des-amino-His, hydroxyl-His, acetyl-His, homo-His, and alpha, alpha-dimethyl imidiazole acetic acid (DMIA). In other embodiments, X2 is selected from the group consisting of: D-Ser, D-Ala, Gly, N-methyl-Ser, Val, and alpha, amino isobutyric acid (AIB). In some embodiments, the glucagon related peptide is covalently linked to a hydrophilic moiety at any of amino acid positions 16, 17, 20, 21, 24, 29, 40, within a C-terminal extension, or at the C-terminal amino acid. In exemplary embodiments, this hydrophilic moiety is covalently linked to a Lys, Cys, Orn, homocysteine, or acetyl-phenylalanine residue at any of these positions. Exemplary hydrophilic moieties include polyethylene glycol (PEG), for example, of a molecular weight of about 1,000 Daltons to about 40,000 Daltons, or about 20,000 Daltons to about 40,000 Daltons.

In other embodiments, the Class I glucagon related peptide comprises the amino acid sequence: X1-X2-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Z (SEQ ID NO: 839), wherein X1 and/or X2 is a non-native amino acid that reduces susceptibility of (or increases resistance of) the glucagon related peptide to cleavage by dipeptidyl peptidase IV (DPP-IV), wherein one, two, three, four or more of positions 16, 20, 21, and 24 of the glucagon related peptide is substituted with an α, α-disubstituted amino acid, and wherein Z is selected from the group consisting of —COOH (the naturally occurring C-terminal carboxylate), -Asn-COOH, Asn-Thr-COOH, and Y—COOH, wherein Y is 1 to 2 amino acids.

Exemplary further amino acid modifications to the foregoing Class 1 glucagon related peptides or analogs include substitution of Thr at position 7 with an amino acid lacking a hydroxyl group, e.g., aminobutyric acid (Abu), Ile, optionally, in combination with substitution or addition of an amino acid comprising a side chain covalently attached (optionally, through a spacer) to an acyl or alkyl group, which acyl or alkyl group is non-native to a naturally-occurring amino acid, substitution of Lys at position 12 with Arg; substitution of Asp at position 15 with Glu; substitution of Ser at position 16 with Thr or AIB; substitution of Gln at position 20 with Ser, Thr, Ala or AIB; substitution of Asp at position 21 with Glu; substitution of Gln at position 24 with Ser, Thr, Ala or AIB; substitution of Met at position 27 with Leu or Nle; substitution of Asn at position 28 with a charged amino acid; substitution of Asn at position 28 with a charged amino acid selected from the group consisting of Lys, Arg, His, Asp, Glu, cysteic acid, and homocysteic acid; substitution at position 28 with Asn, Asp, or Glu; substitution at position 28 with Asp; substitution at position 28 with Glu; substitution of Thr at position 29 with a charged amino acid; substitution of Thr at position 29 with a charged amino acid selected from the group consisting of Lys, Arg, His, Asp, Glu, cysteic acid, and homocysteic acid; substitution at position 29 with Asp, Glu, or Lys; substitution at position 29 with Glu; insertion of 1-3 charged amino acids after position 29; insertion at position 30 (i.e., after position 29) of Glu or Lys; optionally with insertion at position 31 of Lys; addition of SEQ ID NO: 820 to the C-terminus, optionally, wherein the amino acid at position 29 is Thr or Gly; substitution or addition of an amino acid covalently attached to a hydrophilic moiety; or a combination thereof.

Any of the modifications described above in reference to Class 1 glucagon agonists which increase glucagon receptor activity, retain partial glucagon receptor activity, improve solubility, increase stability, or reduce degradation can be applied to Class 1 glucagon related peptides individually or in combination.

Examples of Embodiments of Class 1 Glucagon Related Peptides

In accordance with some embodiments the native glucagon peptide of SEQ ID NO: 801 is modified by the substitution of the native amino acid at position 28 and/or 29 with a negatively charged amino acid (e.g., aspartic acid or glutamic acid) and optionally the addition of a negatively charged amino acid (e.g., aspartic acid or glutamic acid) to the carboxy terminus of the peptide. In an alternative embodiment the native glucagon peptide of SEQ ID NO: 801 is modified by the substitution of the native amino acid at position 29 with a positively charged amino acid (e.g., lysine, arginine or histidine) and optionally the addition of one or two positively charged amino acid (e.g., lysine, arginine or histidine) on the carboxy terminus of the peptide. In accordance with some embodiments a glucagon analog having improved solubility and stability is provided wherein the analog comprises the amino acid sequence of SEQ ID NO: 834 with the proviso that at least one amino acids at position, 28, or 29 is substituted with an acidic amino acid and/or an additional acidic amino acid is added at the carboxy terminus of SEQ ID NO: 834. In some embodiments the acidic amino acids are independently selected from the group consisting of Asp, Glu, cysteic acid and homocysteic acid.

In accordance with some embodiments a glucagon agonist having improved solubility and stability is provided wherein the agonist comprises the amino acid sequence of SEQ ID NO: 833, wherein at least one of the amino acids at positions 27, 28 or 29 is substituted with a non-native amino acid residue (i.e. at least one amino acid present at position 27, 28 or 29 of the analog is an acid amino acid different from the amino acid present at the corresponding position in SEQ ID NO: 801). In accordance with some embodiments a glucagon agonist is provided comprising the sequence of SEQ ID NO: 833 with the proviso that when the amino acid at position 28 is asparagine and the amino acid at position 29 is threonine, the peptide further comprises one to two amino acids, independently selected from the group consisting of Lys, Arg, His, Asp or Glu, added to the carboxy terminus of the glucagon related peptide. In accordance with some embodiments the methionine residue present at position 27 of the native peptide is changed to leucine or norleucine to prevent oxidative degradation of the peptide.

In some embodiments a glucagon analog of SEQ ID NO: 833 is provided wherein 1 to 6 amino acids, selected from positions 1, 2, 5, 7, 10, 11, 12, 13, 14, 16, 17, 18, 19, 20, 21 or 24 of the analog differ from the corresponding amino acid of SEQ ID NO: 801. In accordance with another embodiment a glucagon analog of SEQ ID NO: 833 is provided wherein 1 to 3 amino acids selected from positions 1, 2, 5, 7, 10, 11, 12, 13, 14, 16, 17, 18, 19, 20, 21 or 24 of the analog differ from the corresponding amino acid of SEQ ID NO: 801. In another embodiment, a glucagon analog of SEQ ID NO: 807, SEQ ID NO: 808 or SEQ ID NO: 834 is provided wherein 1 to 2 amino acids selected from positions 1, 2, 5, 7, 10, 11, 12, 13, 14, 16, 17, 18, 19, 20, 21 or 24 of the analog differ from the corresponding amino acid of SEQ ID NO: 801, and in a further embodiment those one to two differing amino acids represent conservative amino acid substitutions relative to the amino acid present in the native sequence (SEQ ID NO: 801). In some embodiments a glucagon related peptide of SEQ ID NO: 811 or SEQ ID NO: 813 is provided wherein the glucagon related peptide further comprises one, two or three amino acid substitutions at positions selected from positions 2, 5, 7, 10, 11, 12, 13, 14, 16, 17, 18, 19, 20, 21, 24, 27 or 29. In some embodiments the substitutions at positions 2, 5, 7, 10, 11, 12, 13, 14, 16, 17, 18, 19, 20, 27 or 29 are conservative amino acid substitutions.

In some embodiments a glucagon agonist is provided comprising an analog peptide of SEQ ID NO: 801 wherein the analog differs from SEQ ID NO: 801 by having an amino acid other than serine at position 2 and by having an acidic amino acid substituted for the native amino acid at position 28 or 29 or an acidic amino acid added to the carboxy terminus of the peptide of SEQ ID NO: 801. In some embodiments the acidic amino acid is aspartic acid or glutamic acid. In some embodiments a glucagon analog of SEQ ID NO: 809, SEQ ID NO: 812, SEQ ID NO: 813 or SEQ ID NO: 832 is provided wherein the analog differs from the parent molecule by a substitution at position 2. More particularly, position 2 of the analog peptide is substituted with an amino acid selected from the group consisting of D-serine, alanine, D-alanine, glycine, n-methyl serine and amino isobutyric acid.

In another embodiment a glucagon agonist is provided comprising an analog peptide of SEQ ID NO: 801 wherein the analog differs from SEQ ID NO: 801 by having an amino acid other than histidine at position 1 and by having an acidic amino acid substituted for the native amino acid at position 28 or 29 or an acidic amino acid added to the carboxy terminus of the peptide of SEQ ID NO: 801. In some embodiments the acidic amino acid is aspartic acid or glutamic acid. In some embodiments a glucagon analog of SEQ ID NO: 809, SEQ ID NO: 812, SEQ ID NO: 813 or SEQ ID NO: 832 is provided wherein the analog differs from the parent molecule by a substitution at position 1. More particularly, position 1 of the analog peptide is substituted with an amino acid selected from the group consisting of DMIA, D-histidine, desaminohistidine, hydroxyl-histidine, acetyl-histidine and homo-histidine.

In accordance with some embodiments the modified glucagon related peptide comprises a sequence selected from the group consisting of SEQ ID NO: 809, SEQ ID NO: 812, SEQ ID NO: 813 and SEQ ID NO: 832. In a further embodiment a glucagon related peptide is provided comprising a sequence of SEQ ID NO: 809, SEQ ID NO: 812, SEQ ID NO: 813 or SEQ ID NO: 832 further comprising one to two amino acids, added to the C-terminus of SEQ ID NO: 809, SEQ ID NO: 812, SEQ ID NO: 813 or SEQ ID NO: 832, wherein the additional amino acids are independently selected from the group consisting of Lys, Arg, His, Asp Glu, cysteic acid or homocysteic acid. In some embodiments the additional amino acids added to the carboxy terminus are selected from the group consisting of Lys, Arg, His, Asp or Glu or in a further embodiment the additional amino acids are Asp or Glu.

In another embodiment the glucagon related peptide comprises the sequence of SEQ ID NO: 7 or a glucagon agonist analog thereof. In some embodiments the peptide comprising a sequence selected from the group consisting of SEQ ID NO: 808, SEQ ID NO: 810, SEQ ID NO: 811, SEQ ID NO: 812 and SEQ ID NO: 813. In another embodiment the peptide comprising a sequence selected from the group consisting of SEQ ID NO: 808, SEQ ID NO: 810 and SEQ ID NO: 811. In some embodiments the glucagon related peptide comprises the sequence of SEQ ID NO: 808, SEQ ID NO: 810 and SEQ ID NO: 811 further comprising an additional amino acid, selected from the group consisting of Asp and Glu, added to the C-terminus of the glucagon related peptide. In some embodiments the glucagon related peptide comprises the sequence of SEQ ID NO: 811 or SEQ ID NO: 813, and in a further embodiment the glucagon related peptide comprises the sequence of SEQ ID NO: 811.

In accordance with some embodiments a glucagon agonist is provided comprising a modified glucagon related peptide selected from the group consisting of:

```
                                                 (SEQ ID NO: 834)
NH2-His-Ser-Gln-Gly-Thr-Phe-Thr-Ser-Asp-Tyr-Ser-

Lys-Tyr-Leu-Xaa-Ser-Arg-Arg-Ala-Gln-Asp-Phe-Val-

Gln-Trp-Leu-Xaa-Xaa-Xaa-R, (SEQ ID NO: 811)
NH2-His-Ser-Gln-Gly-Thr-Phe-Thr-Ser-Asp-Tyr-Ser-

Lys-Tyr-Leu-Asp-Ser-Arg-Arg-Ala-Gln-Asp-Phe-Val-

Gln-Trp-Leu-Met-Asp-Thr-R
and
                                                 (SEQ ID NO: 813)
NH2-His-Ser-Gln-Gly-Thr-Phe-Thr-Ser-Asp-Tyr-Ser- Xaa-Tyr-Leu-Glu-Ser-Arg-Arg-Ala-Gln-Asp-Phe-Val- Gln-Trp-Leu-Met-Asp-Thr-R
``` wherein Xaa at position 15 is Asp, Glu, cysteic acid, homoglutamic acid or homocysteic acid, the Xaa at position 28 is Asn or an acidic amino acid and the Xaa at position 29 is Thr or an acidic amino acid and R is an acidic amino acid, COOH or CONH$_2$, with the proviso that an acidic acid residue is present at one of positions 28, 29 or 30. In some embodiments R is COOH, and in another embodiment R is CONH₂.

The present disclosure also encompasses glucagon fusion peptides wherein a second peptide has been fused to the C-terminus of the glucagon related peptide to enhance the stability and solubility of the glucagon related peptide. More particularly, the fusion glucagon related peptide may comprise a glucagon agonist analog comprising a glucagon related peptide NH₂-His-Ser-Gln-Gly-Thr-Phe-Thr-Ser-Asp-Tyr-Ser-Lys-Tyr-Leu-Xaa-Ser-Arg-Arg-Ala-Gln-Asp-Phe-Val-Gln-Trp-Leu-Xaa-Xaa-Xaa-R (SEQ ID NO: 834), wherein R is an acidic amino acid or a bond and an amino acid sequence of SEQ ID NO: 820 (GPSSGAPPPS), SEQ ID NO: 821 (KRNRNNIA) or SEQ ID NO: 822 (KRNR) linked to the carboxy terminal amino acid of the glucagon related peptide. In some embodiments the glucagon related peptide is selected from the group consisting of SEQ ID NO: 833, SEQ ID NO: 807 or SEQ ID NO: 808 further comprising an amino acid sequence of SEQ ID NO: 820 (GPSSGAPPPS), SEQ ID NO: 821 (KRNRNNIA) or SEQ ID NO: 822 (KRNR) linked to the carboxy terminal amino acid of the glucagon related peptide. In some embodiments the glucagon fusion peptide comprises SEQ ID NO: 802, SEQ ID NO: 803, SEQ ID NO: 804, SEQ ID NO: 805 and SEQ ID NO: 806 or a glucagon agonist analog thereof, further comprising an amino acid sequence of SEQ ID NO: 820 (GPSSGAPPPS), SEQ ID NO: 821 (KRNRNNIA) or SEQ ID NO: 822 (KRNR) linked to amino acid 29 of the glucagon related peptide. In accordance with some embodiments the fusion peptide further comprises a PEG chain linked to an amino acid at position 16, 17, 21, 24, 29, within a C-terminal extension, or at the C-terminal amino acid, wherein the PEG chain is selected from the range of 500 to 40,000 Daltons. In some embodiments the amino acid sequence of SEQ ID NO: 820 (GPSSGAPPPS), SEQ ID NO: 821 (KRNRNNIA) or SEQ ID NO: 822 (KRNR) is bound to amino acid 29 of the glucagon related peptide through a peptide bond. In some embodiments the glucagon related peptide portion of the glucagon fusion peptide comprises a sequence selected from the group consisting of SEQ ID NO: 810, SEQ ID NO: 811 and SEQ ID NO: 813. In some embodiments the glucagon related peptide portion of the glucagon fusion peptide comprises the sequence of SEQ ID NO: 811 or SEQ ID NO: 813, wherein a PEG chain is linked at position 21, 24, 29, within a C-terminal extension or at the C-terminal amino acid, respectively.

In another embodiment the glucagon related peptide sequence of the fusion peptide comprises the sequence of SEQ ID NO: 811, further comprising an amino acid sequence of SEQ ID NO: 820 (GPSSGAPPPS), SEQ ID NO: 821 (KRNRNNIA) or SEQ ID NO: 822 (KRNR) linked to amino acid 29 of the glucagon related peptide. In some embodiments the glucagon fusion peptide comprises a sequence selected from the group consisting of SEQ ID NO: 824, SEQ ID NO: 825 and SEQ ID NO: 826. Typically the fusion peptides of the present invention will have a C-terminal amino acid with the standard carboxylic acid group. However, analogs of those sequences wherein the C-terminal amino acid has an amide substituted for the carboxylic acid are also encompassed as embodiments. In accordance with some embodiments the fusion glucagon related peptide comprises a glucagon agonist analog selected from the group consisting of SEQ ID NO: 810, SEQ ID NO: 811 and SEQ ID NO: 813, further comprising an amino acid sequence of SEQ ID NO: 823 (GPSSGAPPPS-CONH₂) linked to amino acid 29 of the glucagon related peptide.

The glucagon agonists of the present invention can be further modified to improve the peptide's solubility and stability in aqueous solutions while retaining the biological activity of the glucagon related peptide. In accordance with some embodiments, introduction of hydrophilic groups at one or more positions selected from positions 16, 17, 20, 21, 24 and 29 of the peptide of SEQ ID NO: 811, or a glucagon agonist analog thereof, are anticipated to improve the solubility and stability of the pH stabilize glucagon analog. More particularly, in some embodiments the glucagon related peptide of SEQ ID NO: 810, SEQ ID NO: 811, SEQ ID NO: 813, or SEQ ID NO: 832 is modified to comprise one or more hydrophilic groups covalently linked to the side chains of amino acids present at positions 21 and 24 of the glucagon related peptide.

In accordance with some embodiments, the glucagon related peptide of SEQ ID NO: 811 is modified to contain one or more amino acid substitution at positions 16, 17, 20, 21, 24 and/or 29, wherein the native amino acid is substituted with an amino acid having a side chain suitable for crosslinking with hydrophilic moieties, including for example, PEG. The native peptide can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein.

In some embodiments, a glucagon agonist of SEQ ID NO: 810, SEQ ID NO: 811 or SEQ ID NO: 813 is provided wherein the native glucagon peptide sequence has been modified to contain a naturally occurring or synthetic amino acid in at least one of positions 16, 17, 21, 24, 29, within a C-terminal extension or at the C-terminal amino acid of the native sequence, wherein the amino acid substitute further comprises a hydrophilic moiety. In some embodiments the substitution is at position 21 or 24, and in a further embodiment the hydrophilic moiety is a PEG chain. In some embodiments the glucagon related peptide of SEQ ID NO: 811 is substituted with at least one cysteine residue, wherein the side chain of the cysteine residue is further modified with a thiol reactive reagent, including for example, maleimido, vinyl sulfone, 2-pyridylthio, haloalkyl, and haloacyl. These thiol reactive reagents may contain carboxy, keto, hydroxyl, and ether groups as well as other hydrophilic moieties such as polyethylene glycol units. In an alternative embodiment, the native glucagon peptide is substituted with lysine, and the side chain of the substituting lysine residue is further modified using amine reactive reagents such as active esters (succinimido, anhydride, etc) of carboxylic acids or aldehydes of hydrophilic moieties such as polyethylene glycol. In some embodiments the glucagon related peptide is selected from the group consisting of SEQ ID NO: 814, SEQ ID NO: 815, SEQ ID NO: 816, SEQ ID NO: 817, SEQ ID NO: 818 and SEQ ID NO: 819.

In accordance with some embodiments the pegylated glucagon related peptide comprises two or more polyethylene glycol chains covalently bound to the glucagon related peptide wherein the total molecular weight of the glucagon chains is about 1,000 to about 5,000 Daltons. In some embodiments the pegylated glucagon agonist comprises a peptide of SEQ ID NO: 806, wherein a PEG chain is covalently linked to the amino acid residue at position 21 and at position 24, and wherein the combined molecular weight of the two PEG chains is about 1,000 to about 5,000 Daltons. In another embodiment the pegylated glucagon agonist comprises a peptide of SEQ ID NO: 806, wherein a PEG chain is covalently linked to the amino acid residue at position 21 and at position 24, and wherein the combined molecular weight of the two PEG chains is about 5,000 to about 20,000 Daltons.

The polyethylene glycol chain may be in the form of a straight chain or it may be branched. In accordance with some embodiments the polyethylene glycol chain has an average molecular weight selected from the range of about 500 to about 40,000 Daltons. In some embodiments the polyethylene glycol chain has a molecular weight selected from the range of about 500 to about 5,000 Daltons. In another embodiment the polyethylene glycol chain has a molecular weight of about 20,000 to about 40,000 Daltons.

Any of the glucagon related peptides described above may be further modified to include a covalent or non-covalent intramolecular bridge or an alpha helix-stabilizing amino acid within the C-terminal portion of the glucagon related peptide (amino acid positions 12-29). In accordance with some embodiments, the glucagon related peptide comprises any one or more of the modifications discussed above in addition to an amino acid substitution at positions 16, 20, 21, or 24 (or a combination thereof) with an α,α-disubstituted amino acid, e.g., AIB. In accordance with another embodiment, the glucagon related peptide comprises any one or more modifications discussed above in addition to an intramolecular bridge, e.g., a lactam, between the side chains of the amino acids at positions 16 and 20 of the glucagon related peptide.

In accordance with some embodiments, the glucagon related peptide comprises the amino acid sequence of SEQ ID NO: 877, wherein the Xaa at position 3 is an amino acid comprising a side chain of Structure I, II, or III:

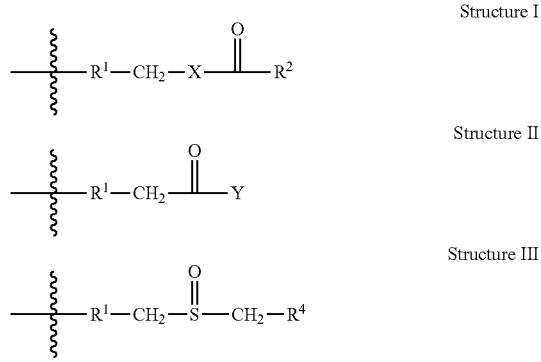

wherein $R^1$ is $C_{0-3}$ alkyl or $C_{0-3}$ heteroalkyl; $R^2$ is $NHR^4$ or $C_{1-3}$ alkyl; $R^3$ is $C_{1-3}$ alkyl; $R^4$ is H or $C_{1-3}$ alkyl; X is NH, O, or S; and Y is $NHR^4$, $SR^3$, or $OR^3$. In some embodiments, X is NH or Y is $NHR^4$. In some embodiments, $R^1$ is $C_{0-2}$ alkyl or $C_1$ heteroalkyl. In some embodiments, $R^2$ is $NHR^4$ or $C_1$ alkyl. In some embodiments, $R^4$ is H or $C^1$ alkyl. In exemplary embodiments an amino acid comprising a side chain of Structure I is provided wherein, $R^1$ is $CH_2$—S, X is NH, and $R^2$ is $CH_3$ (acetamidomethyl-cysteine, C(Acm)); $R^1$ is $CH_2$, X is NH, and $R^2$ is $CH_3$ (acetyldiaminobutanoic acid, Dab(Ac)); $R^1$ is $C_0$ alkyl, X is NH, $R^2$ is $NHR^4$, and $R^4$ is H (carbamoyldiaminopropanoic acid, Dap(urea)); or $R^1$ is $CH_2$—$CH_2$, X is NH, and $R^2$ is $CH_3$ (acetylornithine, Orn (Ac)). In exemplary embodiments an amino acid comprising a side chain of Structure II is provided, wherein $R^1$ is $CH_2$, Y is $NHR^4$, and $R^4$ is $CH_3$ (methylglutamine, Q(Me)); In exemplary embodiments an amino acid comprising a side chain of Structure III is provided wherein, $R^1$ is $CH_2$ and $R^4$ is H (methionine-sulfoxide, M(O)); In specific embodiments, the amino acid at position 3 is substituted with Dab(Ac). For example, glucagon agonists can comprise the amino acid sequence of SEQ ID NO: 863, SEQ ID NO: 869, SEQ ID NO: 871, SEQ ID NO: 872, SEQ ID NO: 873 and SEQ ID NO: 874.

In certain embodiments, the glucagon related peptide is an analog of the glucagon related peptide of SEQ ID NO: 877. In specific aspects, the analog comprises any of the amino acid modifications described herein, including, but not limited to: a substitution of Asn at position 28 with a charged amino acid; a substitution of Asn at position 28 with a charged amino acid selected from the group consisting of Lys, Arg, His, Asp, Glu, cysteic acid, and homocysteic acid; a substitution at position 28 with Asn, Asp, or Glu; a substitution at position 28 with Asp; a substitution at position 28 with Glu; a substitution of Thr at position 29 with a charged amino acid; a substitution of Thr at position 29 with a charged amino acid selected from the group consisting of Lys, Arg, His, Asp, Glu, cysteic acid, and homocysteic acid; a substitution at position 29 with Asp, Glu, or Lys; a substitution at position 29 with Glu; a insertion of 1-3 charged amino acids after position 29; an insertion after position 29 of Glu or Lys; an insertion after position 29 of Gly-Lys or Lys-Lys; and a combination thereof.

In certain embodiments, the analog of the glucagon related peptide of SEQ ID NO: 877 comprises an α,α-disubstituted amino acid, such as AIB, at one, two, three, or all of positions 16, 20, 21, and 24. In certain embodiments, the analog of the glucagon related peptide of SEQ ID NO: 877 comprises one or more of the following: substitution of His at position 1 with a non-native amino acid that reduces susceptibility of the glucagon related peptide to cleavage by dipeptidyl peptidase IV (DPP-IV), substitution of Ser at position 2 with a non-native amino acid that reduces susceptibility of the glucagon related peptide to cleavage by dipeptidyl peptidase IV (DPP-IV), substitution of Thr at position 7 with an amino acid lacking a hydroxyl group, e.g., Abu or Ile; substitution of Tyr at position 10 with Phe or Val; substitution of Lys at position 12 with Arg; substitution of Asp at position 15 with Glu, substitution of Ser at position 16 with Thr or AIB; substitution of Gln at position 20 with Ala or AIB; substitution of Asp at position 21 with Glu; substitution of Gln at position 24 with Ala or AIB; substitution of Met at position 27 with Leu or Nle; deletion of amino acids at positions 27-29; deletion of amino acids at positions 28-29; deletion of the amino acid at positions 29; addition of the amino acid sequence of SEQ ID NO: 820 to the C-terminus, wherein the amino acid at position 29 is Thr or Gly, or a combination thereof.

In accordance with specific embodiments, the glucagon related peptide comprises the amino acid sequence of any of SEQ ID NOs: 862-867 and 869-874. In certain embodiments, the analog of the glucagon related peptide comprising SEQ ID NO: 877 comprises a hydrophilic moiety, e.g., PEG, covalently linked to the amino acid at any of positions 16, 17, 20, 21, 24, and 29 or at the C-terminal amino acid.

In certain embodiments, the analog of the glucagon related peptide comprising SEQ ID NO: 877 comprises an amino acid comprising a side chain covalently attached, optionally, through a spacer, to an acyl group or an alkyl group, which acyl group or alkyl group is non-native to a naturally-occurring amino acid. The acyl group in some embodiments is a C4 to C30 fatty acyl group. In other embodiments, the alkyl group is a C4 to C30 alkyl. In specific aspects, the acyl group or alkyl group is covalently attached to the side chain of the amino acid at position 10. In some embodiments, the amino acid at position 7 is Ile or Abu.

The glucagon agonist may be a peptide comprising the amino acid sequence of any of the SEQ ID NOs: 801-919, optionally with up to 1, 2, 3, 4, or 5 further modifications that retain glucagon agonist activity. In certain embodiments, the glucagon agonist comprises the amino acids of any of SEQ ID NOs: 859-919.

Class 2 Glucagon Related Peptides

In certain embodiments, the glucagon related peptide is a Class 2 glucagon related peptide, which is described herein and in International Patent Application No. PCT US2009/47447 (filed on Jun. 16, 2009), U.S. Provisional Application No. 61/090,448, and U.S. Application No. 61/151,349, the contents of which are incorporated by reference in their entirety. The biological sequences referenced in the following section (SEQ ID NOs: 1001-1262) relating to Class 2 glucagon related peptides correspond to SEQ ID NOs: 1-262 in International Patent Application No. PCT US2009/47447.

Activity

Native glucagon does not activate the GIP receptor, and normally has about 1% of the activity of native-GLP-1 at the GLP-1 receptor. Modifications to the native glucagon sequence described herein produce Class 2 glucagon related peptides that can exhibit potent glucagon activity equivalent to or better than the activity of native glucagon (SEQ ID NO: 1001), potent GIP activity equivalent to or better than the activity of native GIP (SEQ ID NO: 1004), and/or potent GLP-1 activity equivalent to or better than the activity of native GLP-1. In this regard, the Class 2 glucagon related peptide may be one of a glucagon/GIP co-agonist, glucagon/GIP/GLP-1 tri-agonist, GIP/GLP-1 co-agonist, or a GIP agonist glucagon related peptide, as further described herein.

In some embodiments, the Class 2 glucagon related peptides described herein exhibit an EC50 for GIP receptor activation activity of about 100 nM or less, or about 75, 50, 25, 10, 8, 6, 5, 4, 3, 2 or 1 nM or less. In some embodiments, the Class 2 glucagon related peptides exhibit an EC50 for glucagon receptor activation of about 100 nM or less, or about 75, 50, 25, 10, 8, 6, 5, 4, 3, 2 or 1 nM or less. In some embodiments, the Class 2 glucagon related peptides exhibit an EC50 for GLP-1 receptor activation of about 100 nM or less, or about 75, 50, 25, 10, 8, 6, 5, 4, 3, 2 or 1 nM or less. Receptor activation can be measured by in vitro assays measuring cAMP induction in HEK293 cells over-expressing the receptor, e.g. assaying HEK293 cells co-transfected with DNA encoding the receptor and a luciferase gene linked to cAMP responsive element as described in Example 7.

In some embodiments, Class 2 glucagon related peptides exhibit activity at both the glucagon receptor and the GIP receptor ("glucagon/GIP co-agonists"). These Class 2 glucagon related peptides have lost native glucagon's selectivity for glucagon receptor compared to GIP receptor. In some embodiments, the EC50 of the Class 2 glucagon related peptide at the GIP receptor is less than about 50-fold, 40-fold, 30-fold or 20-fold different (higher or lower) from its EC50 at the glucagon receptor. In some embodiments, the GIP potency of the Class 2 glucagon related peptide is less than about 500-, 450-, 400-, 350-, 300-, 250-, 200-, 150-, 100-, 75-, 50-, 25-, 20-, 15-, 10-, or 5-fold different (higher or lower) from its glucagon potency. In some embodiments, the ratio of the EC50 of the Class 2 glucagon related peptide at the GIP receptor divided by the EC50 of the Class 2 glucagon related peptide at the glucagon receptor is less than about 100, 75, 60, 50, 40, 30, 20, 15, 10, or 5. In some embodiments, GLP-1 activity have been significantly reduced or destroyed, e.g., by an amino acid modification at position 7, a deletion of the amino acid(s)C-terminal to the amino acid at position 27 or 28, yielding a 27- or 28-amino acid peptide, or a combination thereof.

In another aspect, Class 2 glucagon related peptides exhibit activity at the glucagon, GIP and GLP-1 receptors ("glucagon/GIP/GLP-1 tri-agonists"). These Class 2 glucagon related peptides have lost native glucagon's selectivity for the glucagon receptor compared to both the GLP-1 and GIP receptors. In some embodiments, the EC50 of the Class 2 glucagon related peptide at the GIP receptor is less than about 50-fold, 40-fold, 30-fold or 20-fold different (higher or lower) from its respective EC50s at the glucagon and GLP-1 receptors. In some embodiments, the GIP potency of the Class 2 glucagon related peptide is less than about 500-, 450-, 400-, 350-, 300-, 250-, 200-, 150-, 100-, 75-, 50-, 25-, 20-, 15-, 10-, or 5-fold different (higher or lower) from its glucagon and GLP-1 potencies. In some embodiments, the ratio of the EC50 of the tri-agonist at the GIP receptor divided by the EC50 of the tri-agonist at the GLP-1 receptor is less than about 100, 75, 60, 50, 40, 30, 20, 15, 10, or 5.

In yet another aspect, Class 2 glucagon related peptides exhibit activity at the GLP-1 and GIP receptors, but in which the glucagon activity has been significantly reduced or destroyed ("GIP/GLP-1 co-agonists"), e.g., by an amino acid modification at position 3. For example, substitution at this position with an acidic, basic, or a hydrophobic amino acid (glutamic acid, ornithine, norleucine) reduces glucagon activity. In some embodiments, the EC50 of the glucagon related peptide at the GIP receptor is less than about 50-fold, 40-fold, 30-fold or 20-fold different (higher or lower) from its EC50 at the GLP-1 receptor. In some embodiments, the GIP potency of the Class 2 glucagon related peptide is less than about 25-, 20-, 15-, 10-, or 5-fold different (higher or lower) from its GLP-1 potency. In some embodiments these Class 2 glucagon related peptides have about 10% or less of the activity of native glucagon at the glucagon receptor, e.g. about 1-10%, or about 0.1-10%, or greater than about 0.1% but less than about 10%. In some embodiments, the ratio of the EC50 of the Class 2 glucagon related peptide at the GIP receptor divided by the EC50 of the Class 2 glucagon related peptide at the GLP-1 receptor is less than about 100, 75, 60, 50, 40, 30, 20, 15, 10, or 5, and no less than 1. In some embodiments, the ratio of the GIP potency of the Class 2 glucagon related peptide compared to the GLP-1 potency of the Class 2 glucagon related peptide is less than about 100, 75, 60, 50, 40, 30, 20, 15, 10, or 5, and no less than 1.

In a further aspect, Class 2 glucagon related peptides exhibit activity at the GIP receptor, in which the glucagon and GLP-1 activity have been significantly reduced or destroyed ("GIP agonist glucagon peptides"), e.g., by amino acid modifications at positions 3 with Glu and 7 with Ile. In some embodiments, these Class 2 glucagon related peptides have about 10% or less of the activity of native glucagon at the glucagon receptor, e.g. about 1-10%, or about 0.1-10%, or greater than about 0.1%, 0.5%, or 1% but less than about 1%, 5%, or 10%. In some embodiments these Class 2 glucagon related peptides also have about 10% or less of the activity of native GLP-1 at the GLP-1 receptor, e.g. about 1-10%, or about 0.1-10%, or greater than about 0.1%, 0.5%, or 1% but less than about 1%, 5%, or 10%.

Modifications

The modifications disclosed herein in reference to a Class 2 glucagon related peptide permit the manipulation of glucagon (SEQ ID NO: 1001) to create glucagon related peptides that exhibit increased GIP activity, glucagon activity, and/or GLP-1 activity.

Modifications that Affect GIP Activity

Enhanced activity at the GIP receptor is provided by an amino acid modification at position 1. For example, His at position 1 is substituted with a large, aromatic amino acid, optionally Tyr, Phe, Trp, amino-Phe, nitro-Phe, chloro-Phe, sulfo-Phe, 4-pyridyl-Ala, methyl-Tyr, or 3-amino Tyr. The combination of Tyr at position 1 with stabilization of the alpha helix within the region corresponding to amino acids 12-29 provided a Class 2 glucagon related peptide that activates the GIP receptor as well as the GLP-1 receptor and the glucagon receptor. The alpha helix structure can be stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid).

Enhanced activity at the GIP receptor is also provided by amino acid modifications at positions 27 and/or 28, and optionally at position 29. For example, the Met at position 27 is substituted with a large aliphatic amino acid, optionally Leu, the Asn at position 28 is substituted with a small aliphatic amino acid, optionally Ala, and the Thr at position 29 is substituted with a small aliphatic amino acid, optionally Gly. Substitution with LAG at positions 27-29 provides increased GIP activity relative to the native MNT sequence at those positions.

Enhanced activity at the GIP receptor is also provided by an amino acid modification at position 12. For example, position 12 is substituted with a large, aliphatic, nonpolar amino acid, optionally Ile. Enhanced activity at the GIP receptor is also provided by an amino acid modification at positions 17 and/or 18. For example, position 17 is substituted with a polar residue, optionally Gln, and position 18 is substituted with a small aliphatic amino acid, optionally Ala. A substitution with QA at positions 17 and 18 provides increased GIP activity relative to the native RR sequence at those positions.

Increased activity at the GIP receptor is provided by modifications that permit formation of an intramolecular bridge between amino acid side chains at positions from 12 to 29. For example, an intramolecular bridge can be formed by a covalent bond between the side chains of two amino acids at positions i and i+4 or between positions j and j+3, or between positions k and k+7. In exemplary embodiments, the bridge is between positions 12 and 16, 16 and 20, 20 and 24, 24 and 28, or 17 and 20. In other embodiments, non-covalent interactions such as salt bridges can be formed between positively and negatively charged amino acids at these positions.

Any of the modifications described above which increase GIP receptor activity can be applied individually or in combination. Combinations of the modifications that increase GIP receptor activity generally provide higher GIP activity than any of such modifications taken alone.

Modifications that Affect Glucagon Activity

In some embodiments, enhanced glucagon potency is provided by an amino acid modification at position 16 of native glucagon (SEQ ID NO: 1001). By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. In some embodiments the glucagon related peptide retains its original selectivity for the glucagon receptor relative to the GLP-1 receptors.

Glucagon receptor activity can be reduced by an amino acid modification at position 3, e.g. substitution of the naturally occurring glutamine at position 3, with an acidic, basic, or a hydrophobic amino acid. For example substitution at position 3 with glutamic acid, ornithine, or norleucine substantially reduces or destroys glucagon receptor activity.

Maintained or enhanced activity at the glucagon receptor may be achieved by modifying the Gln at position 3 with a glutamine analog, as described herein. For example, glucagon agonists can comprise the amino acid sequence of any of SEQ ID NOs: 1243-1248, 1250, 1251, and 1253-1256.

Restoration of glucagon activity which has been reduced by amino acid modifications at positions 1 and 2 is provided by modifications that that stabilize the alpha helix structure of the C-terminal portion (amino acids 12-29) of the glucagon related peptide or analog thereof. For example, an intramolecular bridge can be formed by a covalent bond between the side chains of two amino acids at positions i and i+4 or between positions j and j+3, or between positions k and k+7. In other embodiments, non-covalent interactions such as salt bridges can be formed between positively and negatively charged amino acids at these positions. In yet other embodiments, one or more α, α-disubstituted amino acids are inserted or substituted into this C-terminal portion (amino acids 12-29) at positions that retain the desired activity. For example, one, two, three or all of positions 16, 20, 21 or 24 are substituted with an α, α-disubstituted amino acid, e.g., AIB.

Modifications that Affect GLP-1 Activity

Enhanced activity at the GLP-1 receptor is provided by replacing the carboxylic acid of the C-terminal amino acid with a charge-neutral group, such as an amide or ester. Enhanced activity at the GLP-1 receptor is also provided by stabilizing the alpha-helix structure in the C-terminal portion of glucagon (around amino acids 12-29), e.g., through formation of an intramolecular bridge between the side chains of two amino acids, or substitution and/or insertion of amino acids around positions 12-29 with an alpha helix-stabilizing amino acid (e.g., an α,α-disubstituted amino acid), as further described herein. In exemplary embodiments, the side chains of the amino acid pairs 12 and 16, 13 and 17, 16 and 20, 17 and 21, 20 and 24 or 24 and 28 (amino acid pairs in which i=12, 16, 20, or 24) are linked to one another and thus stabilize the glucagon alpha helix. In some embodiments, the bridge or linker is about 8 (or about 7-9) atoms in length, particularly when the bridge is between positions i and i+4. In some embodiments, the bridge or linker is about 6 (or about 5-7) atoms in length, particularly when the bridge is between positions j and j+3.

In some embodiments, intramolecular bridges are formed by (a) substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms, and (b) substituting the naturally occurring glutamine at position 20 with another hydrophilic amino acid having a side chain that is either charged or has an ability to hydrogen-bond, and is at least about 5 (or about 4-6) atoms in length, for example, lysine, citrulline, arginine, or ornithine. The side chains of such amino acids at positions 16 and 20 can form a salt bridge or can be covalently linked. In some embodiments the two amino acids are bound to one another to form a lactam ring.

In some embodiments, stabilization of the alpha helix structure in the C-terminal portion of the glucagon related peptide is achieved through the formation of an intramolecular bridge other than a lactam bridge. For example, suitable covalent bonding methods include any one or more of olefin metathesis, lanthionine-based cyclization, disulfide bridge or modified sulfur-containing bridge formation, the use of α, ω-diaminoalkane tethers, the formation of metal-atom bridges, and other means of peptide cyclization are used to stabilize the alpha helix.

In yet other embodiments, one or more α, α-disubstituted amino acids are inserted or substituted into this C-terminal portion (amino acids 12-29) at positions that retain the desired activity. For example, one, two, three or all of positions 16, 20, 21 or 24 are substituted with an α, α-disubstituted amino acid, e.g., AIB. Increased activity at the GLP-1 receptor is provided by an amino acid modification at position 20 as described herein. Increased activity at the GLP-1 receptor is also provided by adding GPSSGAPPPS (SEQ ID NO: 1095) or XGPSSGAPPPS (SEQ ID NO: 1096) to the C-terminus. GLP-1 activity in such analogs can be further increased by modifying the amino acid at position 18, 28 or 29, or at position 18 and 29, as described herein. A further modest increase in GLP-1 potency is provided by modifying the amino acid at position 10 to be a large, aromatic amino acid residue, optionally Trp. Potency at the GLP-1 receptor can be further enhanced by an alanine substitution for the native arginine at position 18.

Reduced activity at the GLP-1 receptor is provided, e.g., by an amino acid modification at position 7 as described herein.

Any of the modifications described above in reference to a Class 2 glucagon related peptide which increase GLP-1 receptor activity can be applied individually or in combination. Combinations of the modifications that increase GLP-1 receptor activity generally provide higher GLP-1 activity than any of such modifications taken alone. For example, the invention provides glucagon related peptides that comprise modifications at position 16, at position 20, and at the C-terminal carboxylic acid group, optionally with a covalent bond between the amino acids at positions 16 and 20; glucagon related peptides that comprise modifications at position 16 and at the C-terminal carboxylic acid group; glucagon related peptides that comprise modifications at positions 16 and 20, optionally with a covalent bond between the amino acids at positions 16 and 20; and glucagon related peptides that comprise modifications at position 20 and at the C-terminal carboxylic acid group.

Modifications that Improve DPP-IV Resistance

Modifications at position 1 and/or 2 can increase the peptide's resistance to dipeptidyl peptidase IV (DPP IV) cleavage. For example, position 1 and/or position 2 may be substituted with a DPP-IV resistant amino acid as described herein. In some embodiments, the amino acid at position 2 is substituted with N-methyl alanine.

It was observed that modifications at position 2 (e.g. AIB at position 2) and in some cases modifications at position 1 (e.g., DMIA at position 1) may reduce glucagon activity, sometimes significantly; surprisingly, this reduction in glucagon activity can be restored by stabilizing the alpha-helix structure in the C-terminal portion of glucagon (around amino acids 12-29), e.g., through formation of a covalent bond between the side chains of two amino acids, as described herein. In some embodiments, the covalent bond is between amino acids at positions "i" and "i+4", or positions "j" and "j+3", e.g., between positions 12 and 16, 16 and 20, 20 and 24, 24 and 28, or 17 and 20. In exemplary embodiments, this covalent bond is a lactam bridge between a glutamic acid at position 16 and a lysine at position 20. In some embodiments, this covalent bond is an intramolecular bridge other than a lactam bridge, as described herein.

Modifications that Reduce Degradation

In yet further exemplary embodiments, any of the Class 2 glucagon related peptides can be further modified to improve stability by modifying the amino acid at position 15 and/or 16 of SEQ ID NO: 1001 to reduce degradation of the peptide over time, especially in acidic or alkaline buffers. Such modifications reduce cleavage of the Asp15-Ser16 peptide bond. In exemplary embodiments, the amino acid modification at position 15 is a deletion or substitution of Asp with glutamic acid, homoglutamic acid, cysteic acid or homocysteic acid. In other exemplary embodiments, the amino acid modification at position 16 is a deletion or substitution of Ser with Thr or AIB. In other exemplary embodiments, Ser at position 16 is substituted with glutamic acid or with another negatively charged amino acid having a side chain with a length of 4 atoms, or alternatively with any one of glutamine, homoglutamic acid, or homocysteic acid.

In some embodiments, the methionine residue present at position 27 of the native peptide is modified, e.g. by deletion or substitution. Such modifications may prevent oxidative degradation of the peptide. In some embodiments, the Met at position 27 is substituted with leucine, isoleucine or norleucine. In some specific embodiments, Met at position 27 is substituted with leucine or norleucine.

In some embodiments, the Gln at position 20 and/or 24 is modified, e.g. by deletion or substitution. Such modifications can reduce degradation that occurs through deamidation of Gln. In some embodiments, the Gln at position 20 and/or 24 is substituted with Ser, Thr, Ala or AIB. In some embodiments the Gln at position 20 and/or 24 is substituted with Lys, Arg, Orn, or Citrulline.

In some embodiments, the Asp at position 21 is modified, e.g. by deletion or substitution. Such modifications can reduce degradation that occurs through dehydration of Asp to form a cyclic succinimide intermediate followed by isomerization to iso-aspartate. In some embodiments, position 21 is substituted with Glu, homoglutamic acid or homocysteic acid. In some specific embodiments, position 21 is substituted with Glu.

Stabilization of the Alpha Helix Structure

Stabilization of the alpha-helix structure in the C-terminal portion of the Class 2 glucagon related peptide (around amino acids 12-29) provides enhanced GLP-1 and/or GIP activity and restores glucagon activity which has been reduced by amino acid modifications at positions 1 and/or 2. The alpha helix structure can be stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid). Stabilization of the alpha-helix structure of a GIP agonist may be accomplished as described herein.

EXEMPLARY EMBODIMENTS

In accordance with some embodiments of the invention, the analog of glucagon (SEQ ID NO: 1001) having GIP agonist activity comprises SEQ ID NO: 1001 with (a) an amino acid modification at position 1 that confers GIP agonist activity, (b) a modification which stabilizes the alpha helix structure of the C-terminal portion (amino acids 12-29) of the analog, and (c) optionally, 1 to 10 (e.g., 1, 2, 3, 4, 5, 6, 7, 8, 9, 10) further amino acid modifications. In some embodiments, the analog exhibits at least about 1% activity of native GIP at the GIP receptor or any other activity level at the GIP receptor described herein.

In certain embodiments, the modification which stabilizes the alpha helix structure is one which provides or introduces an intramolecular bridge, including, for example, a covalent intramolecular bridge, such as any of those described herein. The covalent intramolecular bridge in some embodiments is a lactam bridge. The lactam bridge of the analog of these embodiments can be a lactam bridge as described herein. See, e.g., the teachings of lactam bridges under the section "Stabilization of the Alpha Helix Structure." For example, the lactam bridge may be one which is between the side chains of amino acids at positions i and i+4 or between the side chains of amino acids at positions j and j+3, wherein i is 12, 13, 16, 17, 20 or 24, and wherein j is 17. In certain embodiments, the lactam bridge can be between the amino acids at positions 16 and 20, wherein one of the amino acids at positions 16 and 20 is substituted with Glu and the other of the amino acids at positions 16 and 20 is substituted with Lys.

In alternative embodiments, the modification which stabilizes the alpha helix structure is the introduction of one, two, three, or four α,α-disubstituted amino acids at position(s) 16, 20, 21, and 24 of the analog. In some embodiments, the α,α-disubstituted amino acid is AIB. In certain aspects, the α,α-disubstituted amino acid (e.g., AIB) is at position 20 and the amino acid at position 16 is substituted with a positive-charged amino acid, such as, for example, an amino acid of Formula IV, which is described herein. The amino acid of Formula IV may be homoLys, Lys, Orn, or 2,4-diaminobutyric acid (Dab).

In specific aspects of the invention, the amino acid modification at position 1 is a substitution of His with an amino acid lacking an imidazole side chain, e.g. a large, aromatic amino acid (e.g., Tyr).

In certain aspects, the analog of glucagon comprises amino acid modifications at one, two or all of positions 27, 28 and 29. For example, the Met at position 27 can be substituted with a large aliphatic amino acid, optionally Leu, the Asn at position 28 can be substituted with a small aliphatic amino acid, optionally Ala, the Thr at position 29 can be substituted with a small aliphatic amino acid, optionally Gly, or a combination of two or three of the foregoing. In specific embodiments, the analog of glucagon comprises Leu at position 27, Ala at position 28, and Gly or Thr at position 29.

In certain embodiments of the invention, the analog of glucagon comprises an extension of 1 to 21 amino acids C-terminal to the amino acid at position 29. The extension can comprise the amino acid sequence of SEQ ID NO: 1095 or 1096, for instance. Additionally or alternatively, the analog of glucagon can comprise an extension of which 1-6 amino acids of the extension are positive-charged amino acids. The positive-charged amino acids may be amino acids of Formula IV, including, but not limited to Lys, homoLys, Orn, and Dab.

The analog of glucagon in some embodiments is acylated or alkylated as described herein. For instance, the acyl or alkyl group may be attached to the analog of glucagon, with or without a spacer, at position 10 or 40 of the analog, as further described herein. The analog may additionally or alternatively be modified to comprise a hydrophilic moiety as further described herein. Furthermore, in some embodiments, the analog comprises any one or a combination of the following modifications:

(a) Ser at position 2 substituted with D-Ser, Ala, D-Ala, Gly, N-methyl-Ser, AIB, Val, or α-amino-N-butyric acid;
(b) Tyr at position 10 substituted with Trp, Lys, Orn, Glu, Phe, or Val:
(c) Linkage of an acyl group to a Lys at position 10;
(d) Lys at position 12 substituted with Arg or Ile;
(e) Ser at position 16 substituted with Glu, Gln, homoglutamic acid, homocysteic acid, Thr, Gly, or AIB;
(f) Arg at position 17 substituted with Gln;
(g) Arg at position 18 substituted with Ala, Ser, Thr, or Gly;
(h) Gln at position 20 substituted with Ser, Thr, Ala, Lys, Citrulline, Arg, Orn, or AIB;
(i) Asp at position 21 substituted with Glu, homoglutamic acid, homocysteic acid;
(j) Val at position 23 substituted with Ile;
(k) Gln at position 24 substituted with Asn, Ser, Thr, Ala, or AIB;
(l) and a conservative substitution at any of positions 2 5, 9, 10, 11, 12. 13, 14, 15, 16, 8 19 20, 21. 24, 27, 28, and 29.

In exemplary embodiments, the analog of glucagon (SEQ ID NO: 1001) having GIP agonist activity comprises the following modifications:

(a) an amino acid modification at position 1 that confers GIP agonist activity,
(b) a lactam bridge between the side chains of amino acids at positions i and i+4 or between the side chains of amino acids at positions j and j+3, wherein i is 12, 13, 16, 17, 20 or 24, and wherein j is 17,
(c) amino acid modifications at one, two or all of positions 27, 28 and 29, e.g., amino acid modifications at position 27 and/or 28, and
(d) 1-9 or 1-6 further amino acid modifications, e.g. 1, 2, 3, 4, 5, 6, 7, 8 or 9 further amino acid modifications, and the EC50 of the analog for GIP receptor activation is about 10 nM or less.

The lactam bridge of the analog of these embodiments can be a lactam bridge as described herein. For example, the lactam bridge can be between the amino acids at positions 16 and 20, wherein one of the amino acids at positions 16 and 20 is substituted with Glu and the other of the amino acids at positions 16 and 20 is substituted with Lys. In accordance with these embodiments, the analog can comprise, for example, the amino acid sequence of any of SEQ ID NOs: 1005-1094.

In other exemplary embodiments, the analog of glucagon (SEQ ID NO: 1001) having GIP agonist activity comprises the following modifications:

(a) an amino acid modification at position 1 that confers GIP agonist activity,
(b) one, two, three, or all of the amino acids at positions 16, 20, 21, and 24 of the analog is substituted with an α,α-disubstituted amino acid,
(c) amino acid modifications at one, two or all of positions 27, 28 and 29, e.g., amino acid modifications at position 27 and/or 28, and
(d) 1-9 or 1-6 further amino acid modifications, e.g. 1, 2, 3, 4, 5, 6, 7, 8 or 9 further amino acid modifications, and the EC50 of the analog for GIP receptor activation is about 10 nM or less.

The α,α-disubstituted amino acid of the analog of these embodiments can be any α,α-disubstituted amino acid, including, but not limited to, amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the α,α-disubstituted amino acid is AIB. In certain embodiments, the amino acid at position 20 is substituted with an α,α-disubstituted amino acid, e.g., AIB. In accordance with these embodiments, the analog can comprise, for example, the amino acid sequence of any of SEQ ID NOs: 1099-1141, 1144-1164, 1166-1169, and 1173-1178.

In yet other exemplary embodiments, the analog of glucagon (SEQ ID NO: 1001) having GIP agonist activity comprises the following modifications:
(a) an amino acid modification at position 1 that confers GIP agonist activity,
(b) an amino acid substitution of Ser at position 16 with an amino acid of Formula IV:

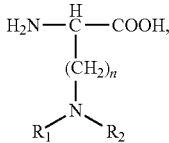

[Formula IV]

wherein n is 1 to 16, or 1 to 10, or 1 to 7, or 1 to 6, or 2 to 6, each of $R_1$ and $R_2$ is independently selected from the group consisting of H, $C_1$-$C_{18}$ alkyl, ($C_1$-$C_{18}$ alkyl)OH, ($C_1$-$C_{18}$ alkyl)$NH_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl)($C_3$-$C_9$ heteroaryl), wherein $R_7$ is H or OH, and the side chain of the amino acid of Formula IV comprises a free amino group,
(c) an amino acid substitution of the Gln at position 20 with an alpha, alpha-disubstituted amino acid,
(d) amino acid modifications at one, two or all of positions 27, 28 and 29, e.g., amino acid modifications at position 27 and/or 28, and
(e) 1-9 or 1-6 further amino acid modifications, e.g. 1, 2, 3, 4, 5, 6, 7, 8 or 9 further amino acid modifications, and the EC50 of the analog for GIP receptor activation is about 10 nM or less.

The amino acid of Formula IV of the analog of these embodiments may be any amino acid, such as, for example, the amino acid of Formula IV, wherein n is 1, 2, 3, 4, 5, 6, 7, 8, 9, 10, 11, 12, 13, 14, 15, or 16. In certain embodiments, n is 2, 3, 4, or 5, in which case, the amino acid is Dab, Orn, Lys, or homoLys respectively.

The alpha, alpha-disubstituted amino acid of the analog of these embodiments may be any alpha, alpha-disubstituted amino acid, including, but not limited to, amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the alpha, alpha-disubstituted amino acid is AIB. In accordance with these embodiments, the analog can comprise, for example, the amino acid sequence of any of SEQ ID NOs: 1099-1165.

In yet other exemplary embodiments, the analog of glucagon (SEQ ID NO: 1001) having GIP agonist activity comprises:
(a) an amino acid modification at position 1 that confers GIP agonist activity, and
(b) an extension of about 1 to about 21 amino acids C-terminal to the amino acid at position 29, wherein at least one of the amino acids of the extension is acylated or alkylated,
wherein the EC50 of the analog for GIP receptor activation is about 10 nM or less.

In some embodiments, the acylated or alkylated amino acid is an amino acid of Formula I, II, or III. In more specific embodiments, the amino acid of Formula I is Dab, Orn, Lys, or homoLys. Also, in some embodiments, the extension of about 1 to about 21 amino acids comprises the amino acid sequence of GPSSGAPPPS (SEQ ID NO: 1095) or XGPSSGAPPPS (SEQ ID NO: 1096), wherein X is any amino acid, or GPSSGAPPPK (SEQ ID NO: 1170) or XGPSSGAPPPK (SEQ ID NO: 1171) or XGPSSGAPPPSK (SEQ ID NO: 1172), wherein X is Gly or a small, aliphatic or non-polar or slightly polar amino acid. In some embodiments, the about 1 to about 21 amino acids may comprise sequences containing one or more conservative substitutions relative to SEQ ID NO: 1095, 1096, 1170, 1171 or 1172. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog.

In some embodiments, the analog having GIP agonist activity further comprises amino acid modifications at one, two or all of positions 27, 28 and 29, e.g., amino acid modifications at position 27 and/or 28.

In any of the above exemplary embodiments, the amino acid modification at position 1 that confers GIP agonist activity can be a substitution of His with an amino acid lacking an imidazole side chain. The amino acid modification at position 1 can, for example, be a substitution of His with a large, aromatic amino acid. In some embodiments, the large, aromatic amino acid is any of those described herein, including, for example, Tyr.

Also, with regard to the above exemplary embodiments, amino acid modifications at one, two, or all of positions 27, 28, and 29 can be any of the modifications at these positions described herein. For example, the Met at position 27 can be substituted with a large aliphatic amino acid, optionally Leu, the Asn at position 28 can be substituted with a small aliphatic amino acid, optionally Ala, and/or the Thr at position 29 can be substituted with a small aliphatic amino acid, optionally Gly. Alternatively, the analog can comprise such amino acid modifications at position 27 and/or 28.

The analog of the above exemplary embodiments can further comprise 1-9 or 1-6 further, additional amino acid modifications, e.g. 1, 2, 3, 4, 5, 6, 7, 8 or 9 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability. The analog can further comprise, for example, an amino acid modification at position 12, optionally, a substitution with Ile, and/or amino acid modifications at positions 17 and 18, optionally substitution with Q at position 17 and A at position 18, and/or an addition of GPSSGAPPPS (SEQ ID NO: 1095) or XGPSSGAPPPS (SEQ ID NO: 1096), or sequences containing one or more conservative substitutions relative to SEQ ID NO: 1095 or 1096, to the C-terminus. The analog can comprise one or more of the following modifications:
(i) Ser at position 2 substituted with D-Ser, Ala, D-Ala, Gly, N-methyl-Ser, AIB, Val, or α-amino-N-butyric acid;
(ii) Tyr at position 10 substituted with Trp, Lys, Orn, Glu, Phe, or Val;
(iii) Linkage of an acyl group to a Lys at position 10;
(iv) Lys at position 12 substituted with Arg;
(v) Ser at position 16 substituted with Glu, Gln, homoglutamic acid, homocysteic acid, Thr, Gly, or AIB;
(vi) Arg at position 17 substituted with Gln;
(vii) Arg at position 18 substituted with Ala, Ser, Thr, or Gly;
(viii) Gln at position 20 substituted with Ala, Ser, Thr, Lys, Citrulline, Arg, Orn, or AIB;
(ix) Asp at position 21 substituted with Glu, homoglutamic acid, homocysteic acid;
(x) Val at position 23 substituted with Ile;
(xi) Gln at position 24 substituted with Asn, Ala, Ser, Thr, or AIB; and
(xii) a conservative substitution at any of positions 2, 5, 9, 10, 11, 12, 13, 14, 15, 16, 17, 18, 19, 20, 21, 24, 27, 28, and 29.

The analog in some embodiments comprise a combination of the modifications (i) through (xii). Alternatively or additionally, the analog can comprise an amino acid modification at position 3 (e.g., an amino acid substitution of Gln with Glu), wherein the analog has less than 1% of the activity of glucagon at the glucagon receptor. Alternatively or additionally, the analog can comprise an amino acid modification at position 7 (e.g., an amino acid substitution of Thr with an amino acid lacking a hydroxyl group, e.g., Abu or Ile), wherein the analog has less than about 10% of the activity of GLP-1 at the GLP-1 receptor.

With regard to the exemplary embodiments, the analog can be covalently linked to a hydrophilic moiety. In some embodiments, the analog is covalently linked to the hydrophilic moiety at any of amino acid positions 16, 17, 20, 21, 24, 29, 40, or the C-terminus. In certain embodiments, the analog comprises a C-terminal extension (e.g., an amino acid sequence of SEQ ID NO: 1095) and an addition of an amino acid comprising the hydrophilic moiety, such that the hydrophilic moiety is covalently linked to the analog at position 40.

In still further exemplary embodiments, the analog of glucagon having GIP agonist activity comprises the amino acid sequence according to any one of SEQ ID NOs: 1227, 1228, 1229 or 1230 that further comprises the following modifications:
(a) optionally, an amino acid modification at position 1 that confers GIP agonist activity,
(b) an extension of about 1 to about 21 amino acids C-terminal to the amino acid at position 29, wherein at least one of the amino acids of the extension is acylated or alkylated, and
(d) up to 6 further amino acid modifications,
wherein the EC50 of the analog for GIP receptor activation is about 10 nM or less. In some aspects, the acylated or alkylated amino acid is an amino acid of Formula I, II, or III. In more specific embodiments, the amino acid of Formula I is Dab, Orn, Lys, or homoLys. Also, in some embodiments, the about 1 to about 21 amino acids comprises the amino acid sequence of GPSSGAPPPS (SEQ ID NO: 1095) or XGPSSGAPPPS (SEQ ID NO: 1096), wherein X is any amino acid, or GPSSGAPPPK (SEQ ID NO: 1170) or XGPSSGAPPPK (SEQ ID NO: 1171) or XGPSSGAPPPSK (SEQ ID NO: 1172), wherein X is Gly or a small, aliphatic or non-polar or slightly polar amino acid. In some embodiments, the about 1 to about 21 amino acids may comprise sequences containing one or more conservative substitutions relative to SEQ ID NO: 1095, 1096, 1170, 1171 or 1172. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog. In any of the above exemplary embodiments, the amino acid at position 1 that confers GIP agonist activity can be an amino acid lacking an imidazole side chain.

The analog of the above exemplary embodiments can further comprise 1-6 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability.

In certain aspects, glucagon analogs described in the above exemplary embodiment, comprise further amino acid modifications at one, two or all of positions 27, 28 and 29. Modifications at these positions can be any of the modifications described herein relative to these positions. For example, relative to SEQ ID NO: 1227, 1228, 1229 or 1230, position 27 can be substituted with a large aliphatic amino acid (e.g., Leu, Ile or norleucine) or Met, position 28 can be substituted with another small aliphatic amino acid (e.g., Gly or Ala) or Asn, and/or position 29 can be substituted with another small aliphatic amino acid (e.g., Ala or Gly) or Thr. Alternatively, the analog can comprise such amino acid modifications at position 27 and/or 28.

The analog can further comprise one or more of the following additional modifications:
(i) the amino acid at position 2 is any one of D-Ser, Ala, D-Ala, Gly, N-methyl-Ser, AIB, Val, or α-amino-N-butyric acid;
(ii) the amino acid at position 10 is Tyr, Trp, Lys, Orn, Glu, Phe, or Val;
(iii) linkage of an acyl group to a Lys at position 10;
(iv) the amino acid at position 12 is Ile, Lys or Arg;
(v) the amino acid at position 16 is any one of Ser, Glu, Gln, homoglutamic acid, homocysteic acid, Thr, Gly, or AIB;
(vi) the amino acid at position 17 is Gln or Arg;
(vii) the amino acid at position 18 is any one of Ala, Arg, Ser, Thr, or Gly;
(viii) the amino acid at position 20 is any one of Ala, Ser, Thr, Lys, Citrulline, Arg, Orn, or AIB or another alpha, alpha-disubstituted amino acid;
(ix) the amino acid at position 21 is any one of Glu, Asp, homoglutamic acid, homocysteic acid;
(x) the amino acid at position 23 is Val or Ile;
(xi) the amino acid at position 24 is any one of Gln, Asn, Ala, Ser, Thr, or AIB; and
(xii) one or more conservative substitutions at any of positions 2, 5, 9, 10, 11, 12, 13, 14, 15, 16, 17, 18, 19, 20, 21, 24, 27, 28, and 29.

The analog in some embodiments comprise a combination of the modifications (i) through (xii). Alternatively or additionally, the analog can comprise an amino acid modification at position 3 (e.g., an amino acid substitution of Gln with Glu), wherein the analog has less than 1% of the activity of glucagon at the glucagon receptor. Alternatively or additionally, the analog can comprise an amino acid modification at position 7 (e.g., an amino acid substitution of Thr with an amino acid lacking a hydroxyl group, e.g., Abu or Ile), wherein the analog has less than about 10% of the activity of GLP-1 at the GLP-1 receptor.

In the above exemplary embodiments, wherein the analog comprises an acyl or alkyl group, the analog may be attached to the acyl or alkyl group via a spacer, as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γGlu-γGlu), a tripeptide, or a hydrophilic or hydrophobic bifunctional spacer. In certain aspects, the total length of the spacer and the acyl or alkyl group is about 14 to about 28 atoms. In some embodiments, the amino acid spacer is not γ-Glu. In some embodiments, the dipeptide spacer is not γ-Glu-γ-Glu.

In some very specific embodiments, an analog of the invention comprises an amino acid sequence selected from the group consisting of SEQ ID NOs: 1099-1141, 1144-1164, 1166, 1192-1207, 1209-1221 and 1223 or selected from the group consisting of SEQ ID NOs: 1167-1169, 1173-1178 and 1225.

In still further exemplary embodiments, the analog of glucagon having GIP agonist activity comprises an acyl or alkyl group (e.g., an acyl or alkyl group which is non-native to a naturally occurring amino acid), wherein the acyl or alkyl group is attached to a spacer, wherein (i) the spacer is attached to the side chain of the amino acid at position 10 of the analog; or (ii) the analog comprises an extension of 1 to 21 amino acids C-terminal to the amino acid at position 29 and the spacer is attached to the side chain of an amino acid corresponding to one of positions 37-43 relative to SEQ ID NO: 1001, wherein the EC50 of the analog for GIP receptor activation is about 10 nM or less.

In such embodiments, the analog may comprise an amino acid sequence of SEQ ID NO: 1001 with (i) an amino acid modification at position 1 that confers GIP agonist activity, (ii) amino acid modifications at one, two, or all of positions 27, 28, and 29, (iii) at least one of:
  (A) the analog comprises a lactam bridge between the side chains of amino acids at positions i and i+4 or between the side chains of amino acids at positions j and j+3, wherein i is 12, 13, 16, 17, 20 or 24, and wherein j is 17;
  (B) one, two, three, or all of the amino acids at positions 16, 20, 21, and 24 of the analog is substituted with an α,α-disubstituted amino acid; or
  (C) the analog comprises (i) an amino acid substitution of Ser at position 16 with an amino acid of Formula IV:

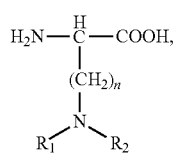

[Formula IV]

wherein n is 1 to 7, wherein each of R1 and R2 is independently selected from the group consisting of H, $C_1$-$C_{18}$ alkyl, ($C_1$-$C_{18}$ alkyl)OH, ($C_1$-$C_{18}$ alkyl)$NH_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl)($C_3$-$C_9$ heteroaryl), wherein $R_7$ is H or OH, and the side chain of the amino acid of Formula IV comprises a free amino group; and (ii) an amino acid substitution of the Gln at position 20 with an alpha, alpha-disubstituted amino acid, and (iv) up to 6 further amino acid modifications.

The alpha, alpha-disubstituted amino acid of the analog of these embodiments may be any alpha, alpha-disubstituted amino acid, including, but not limited to, amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the alpha, alpha-disubstituted amino acid is AIB.

The amino acid of Formula IV of the analog of these embodiments may be any amino acid, such as, for example, the amino acid of Formula IV, wherein n is 1, 2, 3, 4, 5, 6, 7, 8, 9, 10, 11, 12, 13, 14, 15, or 16. In certain embodiments, n is 2, 3, 4, or 5, in which case, the amino acid is Dab, Orn, Lys, or homoLys respectively. In any of the above exemplary embodiments, the amino acid modification at position 1 that confers GIP agonist activity can be a substitution of His with an amino acid lacking an imidazole side chain.

Also, with regard to the above exemplary embodiments, amino acid modifications at one, two, or all of positions 27, 28, and 29 can be any of the modifications at these positions described herein. For example, the Met at position 27 can be substituted with a large aliphatic amino acid, optionally Leu, the Asn at position 28 can be substituted with a small aliphatic amino acid, optionally Ala, and/or the Thr at position 29 can be substituted with a small aliphatic amino acid, optionally Gly. Alternatively, the analog can comprise such amino acid modifications at position 27 and/or 28.

The analog can further comprise, for example, an amino acid modification at position 12, optionally, a substitution with Ile, and/or amino acid modifications at positions 17 and 18, optionally substitution with Q at position 17 and A at position 18, and/or an addition of GPSSGAPPPS (SEQ ID NO: 1095) or XGPSSGAPPPS (SEQ ID NO: 1096), or sequences containing one or more conservative substitutions relative to SEQ ID NO: 1095 or 1096, to the C-terminus. The analog can comprise one or more of the following modifications:
  (i) Ser at position 2 substituted with D-Ser, Ala, D-Ala, Gly, N-methyl-Ser, AIB, Val, or α-amino-N-butyric acid;
  (ii) Tyr at position 10 substituted with Trp, Lys, Orn, Glu, Phe, or Val;
  (iii) Linkage of an acyl group to a Lys at position 10;
  (iv) Lys at position 12 substituted with Arg;
  (v) Ser at position 16 substituted with Glu, Gln, homoglutamic acid, homocysteic acid, Thr, Gly, Lys, or AIB;
  (vi) Arg at position 17 substituted with Gln;
  (vii) Arg at position 18 substituted with Ala, Ser, Thr, or Gly;
  (viii) Gln at position 20 substituted with Ala, Ser, Thr, Lys, Citrulline, Arg, Orn, or AIB;
  (ix) Asp at position 21 substituted with Glu, homoglutamic acid, homocysteic acid;
  (x) Val at position 23 substituted with Ile;
  (xi) Gln at position 24 substituted with Asn, Ala, Ser, Thr, or AIB; and
  (xii) a conservative substitution at any of positions 2, 5, 9, 10, 11, 12, 13, 14, 15, 16, 17, 18, 19, 20, 21, 24, 27, 28, and 29.

The analog in some embodiments comprise a combination of the modifications (i) through (xii). Alternatively or additionally, the analog can comprise an amino acid modification at position 3 (e.g., an amino acid substitution of Gln with Glu), wherein the analog has less than 1% of the activity of glucagon at the glucagon receptor. Alternatively or additionally, the analog can comprise an amino acid modification at position 7 (e.g., an amino acid substitution of Thr with an amino acid lacking a hydroxyl group, e.g., Abu or Ile), a deletion of the amino acid(s) C-terminal to the amino acid at position 27 or 28, yielding a 27- or 28-amino acid peptide, or a combination thereof, wherein the analog has less than about 10% of the activity of GLP-1 at the GLP-1 receptor.

With regard to the exemplary embodiments, the analog can be covalently linked to a hydrophilic moiety. In some embodiments, the analog is covalently linked to the hydrophilic moiety at any of amino acid positions 16, 17, 20, 21, 24, 29, 40, or the C-terminus. In certain embodiments, the analog comprises a C-terminal extension (e.g., an amino acid sequence of SEQ ID NO: 1095) and an addition of an amino acid comprising the hydrophilic moiety, such that the hydrophilic moiety is covalently linked to the analog at position 40.

In some embodiments, the hydrophilic moiety is covalently linked to a Lys, Cys, Orn, homocysteine, or acetyl-phenylalanine of the analog. The Lys, Cys, Orn, homocysteine, or acetyl-phenylalanine may be an amino acid that is native to the glucagon sequence (SEQ ID NO: 1001) or it may be an amino acid which is replacing a native amino acid of SEQ ID NO: 1001. In some embodiments, wherein the hydrophilic moiety is attached to a Cys, the linkage to the hydrophilic moiety can comprise the structure

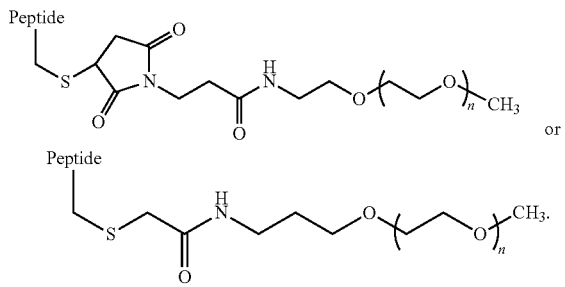

With regard to the analogs comprising a hydrophilic moiety, the hydrophilic moiety may be any of those described herein. See, e.g., the teachings under the section "Linkage of hydrophilic moieties." In some embodiments, the hydrophilic moiety is a polyethylene glycol (PEG). The PEG in certain embodiments has a molecular weight of about 1,000 Daltons to about 40,000 Daltons, e.g., about 20,000 Daltons to about 40,000 Daltons.

In the exemplary embodiments, wherein the analog comprises an acyl or alkyl group, which is attached to the analog via a spacer, the spacer can be any spacer as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γGlu-γGlu), a tripeptide, or a hydrophilic or hydrophobic bifunctional spacer. In certain aspects, the total length of the spacer and the acyl or alkyl group is about 14 to about 28 atoms. In some embodiments, the amino acid spacer is not γ-Glu. In some embodiments, the dipeptide spacer is not γ-Glu-γ-Glu.

The acyl or alkyl group is any acyl or alkyl group as described herein, such as an acyl or alkyl group which is non-native to a naturally occurring amino acid. The acyl or alkyl group in some embodiments is a C4 to C30 fatty acyl group, such as, for example, a C10 fatty acyl or alkyl group, a C12 fatty acyl or alkyl group, a C14 fatty acyl or alkyl group, a C16 fatty acyl or alkyl group, a C18 fatty acyl or alkyl group, a C20 acyl or alkyl group, or a C22 acyl or alkyl group, or a C4 to C30 alkyl group. In specific embodiments, the acyl group is a C12 to C18 fatty acyl group (e.g., a C14 or C16 fatty acyl group).

In some embodiments, the extension of about 1 to about 21 amino acids C-terminal to the amino acid at position 29 of the analog comprises the amino acid sequence of GPSSGAPPPS (SEQ ID NO: 1095) or XGPSSGAPPPS (SEQ ID NO: 1096), wherein X is any amino acid, or GPSSGAPPPK (SEQ ID NO: 1170) or XGPSSGAPPPK (SEQ ID NO: 1171) or XGPSSGAPPPSK (SEQ ID NO: 1172), wherein X is Gly or a small, aliphatic or non-polar or slightly polar amino acid. In some embodiments, the about 1 to about 21 amino acids may comprise sequences containing one or more conservative substitutions relative to SEQ ID NO: 1095, 1096, 1170, 1171 or 1172. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog. In certain embodiments, the acyl or alkyl group is covalently linked to an amino acid which is native to SEQ ID NO: 1001, 1227, 1228, 1229 or 1230 or it may be linked to a substituted amino acid. In certain embodiments, the acyl or alkyl group is covalently linked to an amino acid which is native to SEQ ID NO: 1095, 1096, 1171 or 1172

The GIP agonist may be a peptide comprising the amino acid sequence of any of the amino acid sequences, e.g., SEQ ID NOs: 1005-1094, optionally with up to 1, 2, 3, 4, or 5 further modifications that retain GIP agonist activity. In certain embodiments, the GIP agonist comprises the amino acids of any of SEQ ID NOs: 1099-1262.

Class 3 Glucagon Related Peptides

In certain embodiments, the glucagon related peptide is a Class 3 glucagon related peptide, which is described herein and in International Patent Application No. PCT/US2009/47438 (filed on Jun. 16, 2009), International Patent Application Publication No. WO 2008/101017, published on Aug. 21, 2008, and U.S. Provisional Application No. 61/090,412 and U.S. Application No. 61/177,476, the contents of which are incorporated by reference in their entirety.

Some of the biological sequences referenced in the following section (SEQ ID NOs: 89-108, 114-128 and 146-656) relating to Class 3 glucagon related peptides correspond to SEQ ID NOs: 89-108, 114-128 and 146-656 in International Patent Application No. PCT/US2009/47438.

Activity

The Class 3 glucagon related peptide can be a peptide that exhibits increased activity at the glucagon receptor, and in further embodiments exhibits enhanced biophysical stability and/or aqueous solubility. In addition, in some embodiments, the Class 3 glucagon related peptide has lost native glucagon's selectivity for the glucagon receptor verses the GLP-1 receptor, and thus represents co-agonists of those two receptors. Selected amino acid modifications within the Class 3 glucagon related peptide can control the relative activity of the peptide at the GLP-1 receptor verses the glucagon receptor. Thus, the Class 3 glucagon related peptide can be a glucagon/GLP-1 co-agonist that has higher activity at the glucagon receptor versus the GLP-1 receptor, a glucagon/GLP-1 co-agonist that has approximately equivalent activity at both receptors, or a glucagon/GLP-1 co-agonist that has higher activity at the GLP-1 receptor versus the glucagon receptor. The latter category of co-agonist can be engineered to exhibit little or no activity at the glucagon receptor, and yet retain ability to activate the GLP-1 receptor with the same or better potency than native GLP-1. Any of these co-agonists may also include modifications that confer enhanced biophysical stability and/or aqueous solubility.

Modifications of the Class 3 glucagon related peptide can be made to produce a glucagon related peptide having anywhere from at least about 1% (including at least about 1.5%, 2%, 5%, 7%, 10%, 20%, 30%, 40%, 50%, 60%, 75%, 100%, 125%, 150%, 175%) to about 200% or higher activity at the GLP-1 receptor relative to native GLP-1 and anywhere from at least about 1% (including about 1.5%, 2%, 5%, 7%, 10%, 20%, 30%, 40%, 50%, 60%, 75%, 100%, 125%, 150%, 175%, 200%, 250%, 300%, 350%, 400%, 450%) to about 500% or higher activity at the glucagon receptor relative to native glucagon. The amino acid sequence of native glucagon is SEQ ID NO: 701, the amino acid sequence of GLP-1(7-36)amide is SEQ ID NO: 703, and the amino acid sequence of GLP-1(7-37)acid is SEQ ID NO: 704.

The Class 3 glucagon related peptide can be a glucagon related peptide with increased or decreased activity at the glucagon receptor, or GLP-1 receptor, or both. The Class 3 glucagon related peptide can be a glucagon related peptide with altered selectivity for the glucagon receptor versus the GLP-1 receptor. As disclosed herein high potency Class 3 glucagon related peptides are provided that also exhibit improved solubility and/or stability.

Modifications Affecting Glucagon Activity

Increased activity at the glucagon receptor is provided by an amino acid modification at position 16 of native glucagon (SEQ ID NO: 701). In some embodiments, the Class 3 glucagon related peptide is a glucagon agonist that has been modified relative to the wild type peptide of His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asn-Thr (SEQ ID NO: 701) to enhance the peptide's potency at the glucagon receptor. The normally occurring serine at position 16 of native glucagon (SEQ ID NO: 701) can be substituted with select acidic amino acids to enhance the potency of glucagon, in terms of its ability to stimulate cAMP synthesis in a validated in vitro model assay (see Example 7). More particularly, this substitution enhances the potency of the analog at least 2-fold, 4-fold, 5-fold, and up to 10-fold greater at the glucagon receptor. This substitution also enhances the analog's activity at the GLP-1 receptor at least 5-fold, 10-fold, or 15-fold relative to native glucagon, but selectivity is maintained for the glucagon receptor over the GLP-1 receptor.

By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. In accordance with some embodiments, the serine residue at position 16 of native glucagon is substituted with an amino acid selected from the group consisting of glutamic acid, glutamine, homoglutamic acid, homocysteic acid, threonine, or glycine. In accordance with some embodiments, the serine residue at position 16 of native glucagon is substituted with an amino acid selected from the group consisting of glutamic acid, glutamine, homoglutamic acid and homocysteic acid, and in some embodiments the serine residue is substituted with glutamic acid.

In some embodiments, the enhanced potency Class 3 glucagon related peptide comprises a peptide of SEQ ID NO: 90, SEQ ID NO: 91, SEQ ID NO: 92, SEQ ID NO: 93, SEQ ID NO: 94, SEQ ID NO: 95 or a glucagon agonist analog of SEQ ID NO: 93. In accordance with some embodiments, a Class 3 glucagon related peptide having enhanced potency at the glucagon receptor relative to wild type glucagon is provided wherein the peptide comprises the sequence of SEQ ID NO: 95, SEQ ID NO: 96, SEQ ID NO: 97 or SEQ ID NO: 98, wherein the glucagon related peptide retains its selectivity for the glucagon receptor relative to the GLP-1 receptors. In some embodiments, the Class 3 glucagon related peptide having enhanced specificity for the glucagon receptor comprises the peptide of SEQ ID NO: 96, SEQ ID NO: 97, SEQ ID NO: 98 or a glucagon agonist analog thereof, wherein the carboxy terminal amino acid retains its native carboxylic acid group. In accordance with some embodiments, a Class 3 glucagon related peptide comprises the sequence of NH2-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Gln-Trp-Leu-Met-Asn-Thr-COOH (SEQ ID NO: 98), wherein the peptide exhibits approximately fivefold enhanced potency at the glucagon receptor, relative to native glucagon as measured by the in vitro cAMP assay of Example 7.

Glucagon receptor activity can be reduced, maintained, or enhanced by an amino acid modification at position 3, e.g. substitution of the naturally occurring glutamine at position 3. In some embodiments, substitution of the amino acid at position 3 with an acidic, basic, or hydrophobic amino acid (glutamic acid, ornithine, norleucine) has been shown to substantially reduce or destroy glucagon receptor activity. The analogs that are substituted with, for example, glutamic acid, ornithine, or norleucine have about 10% or less of the activity of native glucagon at the glucagon receptor, e.g. about 1-10%, or about 0.1-10%, or greater than about 0.1% but less than about 10%, while exhibiting at least 20% of the activity of GLP-1 at the GLP-1 receptor. For example, exemplary analogs described herein have about 0.5%, about 1% or about 7% of the activity of native glucagon, while exhibiting at least 20% of the activity of GLP-1 at the GLP-1 receptor. In particular, any of the Class 3 glucagon related peptides, including glucagon analogs, glucagon agonist analogs, glucagon co-agonists, and glucagon/GLP-1 co-agonist molecules, described herein may be modified to contain a modification at position 3, e.g., Gln substituted with Glu, to produce a peptide with high selectivity, e.g., tenfold selectivity, for the GLP-1 receptor as compared to the selectivity for the glucagon receptor.

In another embodiment, the naturally occurring glutamine at position 3 of any of the Class 3 glucagon related peptides can be substituted with a glutamine analog without a substantial loss of activity at the glucagon receptor, and in some cases, with an enhancement of glucagon receptor activity, as described herein. In specific embodiments, the amino acid at position 3 is substituted with Dab(Ac). For example, glucagon agonists can comprise the amino acid sequence of SEQ ID NO: 595, SEQ ID NO: 601 SEQ ID NO: 603, SEQ ID NO: 604, SEQ ID NO: 605, and SEQ ID NO: 606.

It was observed that modifications at position 2 (e.g. AIB at position 2) and in some cases modifications at position 1 may reduce glucagon activity. This reduction in glucagon activity can be restored by stabilizing the alpha-helix in the C-terminal portion of glucagon, e.g. through means described herein, for example, through a covalent bond between the side chains of the amino acids at positions "i" and "i+4", e.g., 12 and 16, 16 and 20, or 20 and 24. In some embodiments, this covalent bond is a lactam bridge between a glutamic acid at position 16 and a lysine at position 20. In some embodiments, this covalent bond is an intramolecular bridge other than a lactam bridge. For example, suitable covalent bonding methods include any one or more of olefin metathesis, lanthionine-based cyclization, disulfide bridge or modified sulfur-containing bridge formation, the use of α, ω-diaminoalkane tethers, the formation of metal-atom bridges, and other means of peptide cyclization.

Modifications Affecting GLP-1 Activity

Enhanced activity at the GLP-1 receptor is provided by replacing the carboxylic acid of the C-terminal amino acid with a charge-neutral group, such as an amide or ester. In some embodiments, these Class 3 glucagon related peptides comprise a sequence of SEQ ID NO: 108, wherein the carboxy terminal amino acid has an amide group in place of the carboxylic acid group found on the native amino acid. These Class 3 glucagon related peptides have strong activity at both the glucagon and GLP-1 receptors and thus act as co-agonists at both receptors. In accordance with some embodiments, the Class 3 glucagon related peptide is a glucagon and GLP-1 receptor co-agonist, wherein the peptide comprises the sequence of SEQ ID NO: 108, wherein the amino acid at position 28 is Asn or Lys and the amino acid at position 29 is Thr-amide.

Increased activity at the GLP-1 receptor is provided by modifications that stabilize the alpha helix in the C-terminal portion of glucagon (e.g. around residues 12-29). In some embodiments, such modifications permit formation of an intramolecular bridge between the side chains of two amino acids that are separated by three intervening amino acids (i.e., an amino acid at position "i" and an amino acid at position "i+4", wherein i is any integer between 12 and 25), by two intervening amino acids, i.e., an amino acid at position "j" and an amino acid at position "j+3," wherein j is any integer between 12 and 27, or by six intervening amino acids, i.e., an amino acid at position "k" and an amino acid at position "k+7," wherein k is any integer between 12 and 22. In exemplary embodiments, the bridge or linker is about 8 (or about 7-9) atoms in length and forms between side chains of amino acids at positions 12 and 16, or at positions 16 and 20, or at positions 20 and 24, or at positions 24 and 28. The two amino acid side chains can be linked to one another through non-covalent bonds, e.g., hydrogen-bonding, ionic interactions, such as the formation of salt bridges, or by covalent bonds.

In accordance with some embodiments, the Class 3 glucagon related peptide exhibits glucagon/GLP-1 receptor co-agonist activity and comprises an amino acid sequence selected from the group consisting of SEQ ID NO: 99, 101, 102 and 103. In some embodiments, the side chains are covalently bound to one another, and in some embodiments the two amino acids are bound to one another to form a lactam ring.

In some embodiments, the Class 3 glucagon related peptide comprises a glucagon related peptide analog of SEQ ID NO: 108, wherein the peptide comprises an intramolecular lactam bridge formed between amino acid positions 12 and 16 or between amino acid positions 16 and 20. In some embodiments, the Class 3 glucagon related peptide comprises the sequence of SEQ ID NO: 108, wherein an intramolecular lactam bridge is formed between amino acid positions 12 and 16, between amino acid positions 16 and 20, or between amino acid positions 20 and 24 and the amino acid at position 29 is glycine, wherein the sequence of SEQ ID NO: 29 is linked to the C-terminal amino acid of SEQ ID NO: 108. In a further embodiment, the amino acid at position 28 is aspartic acid.

In some specific embodiments, stabilization of the alpha helix structure in the C-terminal portion of the Class 3 glucagon related peptide is achieved through the formation of an intramolecular bridge other than a lactam bridge. For example, suitable covalent bonding methods include any one or more of olefin metathesis, lanthionine-based cyclization, disulfide bridge or modified sulfur-containing bridge formation, the use of α, ω-diaminoalkane tethers, the formation of metal-atom bridges, and other means of peptide cyclization are used to stabilize the alpha helix.

Furthermore, enhanced activity at the GLP-1 receptor may be achieved by stabilizing the alpha-helix structure in the C-terminal portion of the glucagon related peptide (around amino acids 12-29) through purposeful introduction of one or more α, α-disubstituted amino acids at positions that retain the desired activity. Such peptides may be considered herein as a peptide lacking an intramolecular bridge. In some aspects, stabilization of the alpha-helix is accomplished in this manner without introduction of an intramolecular bridge such as a salt bridge or covalent bond. In some embodiments, one, two, three, four or more of positions 16, 17, 18, 19, 20, 21, 24 or 29 of a glucagon related peptide is substituted with an α, α-disubstituted amino acid. For example, substitution of position 16 of the Class 3 glucagon related peptide with amino iso-butyric acid (AIB) enhances GLP-1 activity, in the absence of a salt bridge or lactam. In some embodiments, one, two, three or more of positions 16, 20, 21 or 24 are substituted with AIB.

Enhanced activity at the GLP-1 receptor may be achieved by an amino acid modification at position 20. In some embodiments, the glutamine at position 20 is replaced with another hydrophilic amino acid having a side chain that is either charged or has an ability to hydrogen-bond, and is at least about 5 (or about 4-6) atoms in length, for example, lysine, citrulline, arginine, or ornithine.

Increased activity at the GLP-1 receptor is demonstrated in Class 3 glucagon related peptides comprising the C-terminal extension of SEQ ID NO: 78. GLP-1 activity in such Class 3 glucagon related peptides comprising SEQ ID NO: 78 can be further increased by modifying the amino acid at position 18, 28 or 29, or at position 18 and 29, as described herein. A further modest increase in GLP-1 potency may be achieved by modifying the amino acid at position 10 to be Trp.

Combinations of the modifications that increase GLP-1 receptor activity may provide higher GLP-1 activity than any of such modifications taken alone. For example, the Class 3 glucagon related peptides can comprise modifications at position 16, at position 20, and at the C-terminal carboxylic acid group, optionally with a covalent bond between the amino acids at positions 16 and 20; can comprise modifications at position 16 and at the C-terminal carboxylic acid group; can comprise modifications at positions 16 and 20, optionally with a covalent bond between the amino acids at positions 16 and 20; or can comprise modifications at position 20 and at the C-terminal carboxylic acid group; optionally with the proviso that the amino acid at position 12 is not Arg; or optionally with the proviso that the amino acid at position 9 is not Glu.

Modifications Affecting Solubility

Addition of Hydrophilic Moieties

The Class 3 glucagon related peptides can be further modified to improve the peptide's solubility and stability in aqueous solutions at physiological pH, while retaining the high biological activity relative to native glucagon. Hydrophilic moieties as discussed herein can be attached to the Class 3 glucagon related peptide as further discussed herein. In accordance with some embodiments, introduction of hydrophilic groups at positions 17, 21, and 24 of the Class 3 glucagon related peptide comprising SEQ ID NO: 97 or SEQ ID NO: 98 are anticipated to improve the solubility and stability of the high potency glucagon analog in solutions having a physiological pH. Introduction of such groups also increases duration of action, e.g. as measured by a prolonged half-life in circulation.

In some embodiments, the Class 3 glucagon related peptide comprises a sequence selected from the group consisting of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106 and SEQ ID NO: 107, wherein the side chain of an amino acid residue at one of position 16, 17, 21 or 24 of said Class 3 glucagon related peptide further comprises a polyethylene glycol chain, having a molecular weight selected from the range of about 500 to about 40,000 Daltons. In some embodiments, the polyethylene glycol chain has a molecular weight selected from the range of about 500 to about 5,000 Daltons. In another embodiment. the polyethylene glycol chain has a molecular weight of about 10,000 to about 20,000 Daltons. In yet other exemplary embodiments the polyethylene glycol chain has a molecular weight of about 20,000 to about 40,000 Daltons. In accordance with some embodiments the hydrophilic group comprises a polyethylene (PEG) chain. More particularly, in some embodiments, the Class 3 glucagon related peptide comprises the sequence of SEQ ID NO: 94 or SEQ ID NO: 95 wherein a PEG chain is covalently linked to the side chains of amino acids present at positions 21 and 24 of the Class 3 glucagon related peptide and the carboxy terminal amino acid of the Class 3 glucagon related peptide has the carboxylic acid group. In accordance with some embodiments, the polyethylene glycol chain has an average molecular weight selected from the range of about 500 to about 10,000 Daltons.

In accordance with some embodiments, the pegylated Class 3 glucagon related peptide comprises two or more polyethylene glycol chains covalently bound to the Class 3 glucagon related peptide wherein the total molecular weight of the glucagon chains is about 1,000 to about 5,000 Daltons. In some embodiments the pegylated glucagon agonist comprises a peptide consisting of SEQ ID NO: 93 or a glucagon agonist analog of SEQ ID NO: 93, wherein a PEG chain is covalently linked to the amino acid residue at position 21 and at position 24, and wherein the combined molecular weight of the two PEG chains is about 1,000 to about 5,000 Daltons.

Charged C-Terminus

The solubility of the Class 3 glucagon related peptide comprising SEQ ID NO: 20 can be further improved, for example, by introducing one, two, three or more charged amino acid(s) to the C-terminal portion of glucagon related peptide of SEQ ID NO: 108, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. Additional modifications, e.g. conservative substitutions, may be made to the Class 3 glucagon related peptide that still allow it to retain glucagon activity. In some embodiments, an analog of the Class 3 glucagon related peptide of SEQ ID NO: 108 is provided wherein the analog differs from SEQ ID NO: 108 by 1 to 2 amino acid substitutions at positions 17-26, and, in some embodiments, the analog differs from the peptide of SEQ ID NO: 108 by an amino acid substitution at position 20.

Acylation/Alkylation

In accordance with some embodiments, the glucagon related peptide is modified to comprise an acyl or alkyl group, e.g., a C4 to C30 acyl or alkyl group. In some embodiments, the invention provides a Class 3 glucagon related peptide modified to comprise an acyl group or alkyl group covalently linked to the amino acid at position 10 of the glucagon related peptide. The glucagon related peptide may further comprise a spacer between the amino acid at position 10 of the Class 3 glucagon related peptide and the acyl group or alkyl group. Any of the foregoing Class 3 glucagon related peptides may comprise two acyl groups or two alkyl groups, or a combination thereof. In a specific aspect of the invention, the acylated Class 3 glucagon related peptide comprises the amino acid sequence of any of SEQ ID NOs: 534-544 and 546-549.

C-Terminal Truncation

In some embodiments, the Class 3 glucagon related peptides described herein are further modified by truncation or deletion of one or two amino acids of the C-terminus of the glucagon peptide (i.e., position 29 and/or 28) without affecting activity and/or potency at the glucagon and GLP-1 receptors. In this regard, the Class 3 glucagon related peptide can comprise amino acids 1-27 or 1-28 of the native glucagon peptide (SEQ ID NO: 1), optionally with one or more modifications described herein. In some embodiments, the truncated Class 3 glucagon related peptide comprises SEQ ID NO: 550 or SEQ ID NO: 551. In another embodiment, the truncated glucagon agonist peptide comprises SEQ ID NO: 552 or SEQ ID NO: 553.

C-Terminal Extension

In accordance with some embodiments, the Class 3 glucagon related peptides disclosed herein are modified by the addition of a second peptide to the carboxy terminus of the glucagon related peptide, for example, SEQ ID NO: 78, SEQ ID NO: 117 or SEQ ID NO: 118. In some embodiments, a Class 3 glucagon related peptide having a sequence selected from the group consisting of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 109, SEQ ID NO: 110, SEQ ID NO: 111, and SEQ ID NO: 69 is covalently bound through a peptide bond to a second peptide, wherein the second peptide comprises a sequence selected from the group consisting of SEQ ID NO: 78, SEQ ID NO: 117 and SEQ ID NO: 118. In a further embodiment, in Class 3 glucagon related peptides which comprise the C-terminal extension, the threonine at position 29 of the native glucagon related peptide is replaced with a glycine. A Class 3 glucagon related peptide having a glycine substitution for threonine at position 29 and comprising the carboxy terminal extension of SEQ ID NO: 78 is four times as potent at the GLP-1 receptor as native glucagon modified to comprise the carboxy terminal extension of SEQ ID NO: 78. Potency at the GLP-1 receptor can be further enhanced by an alanine substitution for the native arginine at position 18.

Accordingly, the Class 3 glucagon related peptide can have a carboxy terminal extension of SEQ ID NO: 117 (KRNRNNIA) or SEQ ID NO: 118. In accordance with some embodiments, Class 3 glucagon related peptide comprising SEQ ID NO: 81 or SEQ ID NO: 108, further comprises the amino acid sequence of SEQ ID NO: 117

(KRNRNNIA) or SEQ ID NO: 118 linked to amino acid 29 of the glucagon related peptide. More particularly, the Class 3 glucagon related peptide comprises a sequence selected from the group consisting of SEQ ID NO: 98, SEQ ID NO: 100, SEQ ID NO: 101, SEQ ID NO: 102 and SEQ ID NO: 103, further comprising the amino acid sequence of SEQ ID NO: 117 (KRNRNNIA) or SEQ ID NO: 118 linked to amino acid 29 of the glucagon related peptide. More particularly, the glucagon related peptide comprises a sequence selected from the group consisting of SEQ ID NO: 98, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 109, SEQ ID NO: 110, SEQ ID NO: 111, SEQ ID NO: 112, SEQ ID NO: 72 and SEQ ID NO: 120 further comprising the amino acid sequence of SEQ ID NO: 78 (GPSSGAPPPS) or SEQ ID NO: 79 linked to amino acid 29 of the Class 3 glucagon related peptide. In some embodiments, the Class 3 glucagon related peptide comprises the sequence of SEQ ID NO: 121.

Any of the modifications described above with regard to Class 3 glucagon related peptides which increase or decrease glucagon receptor activity and which increase GLP-1 receptor activity can be applied individually or in combination. Exemplary modifications include but are not limited to:

(A) Improving solubility, for example, by introducing one, two, three or more charged amino acid(s) to the C-terminal portion of native glucagon, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. In other embodiments, one, two, three or all of the charged amino acids are positively charged. Such modifications increase solubility, e.g. provide at least 2-fold, 5-fold, 10-fold, 15-fold, 25-fold, 30-fold or greater solubility relative to native glucagon at a given pH between about 5.5 and 8, e.g., pH 7, when measured after 24 hours at 25° C.

(B) Increasing solubility and duration of action or half-life in circulation by addition of a hydrophilic moiety such as a polyethylene glycol chain, as described herein, e.g. at position 16, 17, 20, 21, 24 or 29, or at the C-terminal amino acid of the peptide.

(C) Increasing stability by modification of the aspartic acid at position 15, for example, by deletion or substitution with glutamic acid, homoglutamic acid, cysteic acid or homocysteic acid. Such modifications can reduce degradation or cleavage at a pH within the range of 5.5 to 8, especially in acidic or alkaline buffers, for example, retaining at least 75%, 80%, 90%, 95%, 96%, 97%, 98% or 99% of the original peptide after 24 hours at 25° C.

(D) Increasing stability by modification of the methionine at position 27, for example, by substitution with leucine or norleucine. Such modifications can reduce oxidative degradation. Stability can also be increased by modification of the Gln at position 20 or 24, e.g. by substitution with Ser, Thr, Ala or AIB. Such modifications can reduce degradation that occurs through deamidation of Gln. Stability can be increased by modification of Asp at position 21, e.g. by substitution with Glu. Such modifications can reduce degradation that occurs through dehydration of Asp to form a cyclic succinimide intermediate followed by isomerization to iso-aspartate.

(E) Increasing resistance to dipeptidyl peptidase IV (DPP IV) cleavage by modification of the amino acid at position 1 or 2 with the DPP-IV resistant amino acids described herein and including modification of the amino acid at position 2 with N-methyl-alanine.

(F) Conservative or non-conservative substitutions, additions or deletions that do not affect activity, for example, conservative substitutions at one or more of positions 2, 5, 7, 10, 11, 12, 13, 14, 16, 17, 18, 19, 20, 21, 24, 27, 28 or 29; deletions at one or more of positions 27, 28 or 29; or a deletion of amino acid 29 optionally combined with a C-terminal amide or ester in place of the C-terminal carboxylic acid group;

(G) Adding C-terminal extensions as described herein;

(H) Increasing half-life in circulation and/or extending the duration of action and/or delaying the onset of action, for example, through acylation or alkylation of the glucagon related peptide, as described herein;

(I) Homodimerization or heterodimerization as described herein.

Other modifications include substitution of His at position 1 with a large, aromatic amino acid (e.g., Tyr, Phe, Trp or amino-Phe); Ser at position 2 with Ala; substitution of Tyr at position 10 with Val or Phe; substitution of Lys at position 12 with Arg; substitution of Asp at position 15 with Glu; substitution of Ser at position 16 with Thr or AIB.

Class 3 glucagon related peptides with GLP-1 activity that contain a non-conservative substitution of His at position 1 with a large, aromatic amino acid (e.g., Tyr) can retain GLP-1 activity provided that the alpha-helix is stabilized via an intramolecular bridge, e.g., such as any of those described herein.

Conjugates and Fusions

The Class 3 glucagon related peptide can be linked, optionally via covalent bonding and optionally via a linker, to a conjugate moiety. The Class 3 glucagon related peptide also can be part of a fusion peptide or protein wherein a second peptide or polypeptide has been fused to a terminus, e.g., the carboxy terminus of the Class 3 glucagon related peptide. More particularly, the fusion Class 3 glucagon related peptide may comprise a glucagon agonist of SEQ ID NO: 72, SEQ ID NO: 97 or SEQ ID NO: 98 further comprising an amino acid sequence of SEQ ID NO: 78 (GPSSGAPPPS), SEQ ID NO: 117 (KRNRNNIA) or SEQ ID NO: 118 (KRNR) linked to amino acid 29 of the glucagon related peptide. In some embodiments, the amino acid sequence of SEQ ID NO: 78 (GPSSGAPPPS), SEQ ID NO: 117 (KRNRNNIA) or SEQ ID NO: 118 (KRNR) is bound to amino acid 29 of the Class 3 glucagon related peptide through a peptide bond. Applicants have discovered that in Class 3 glucagon related peptide fusion peptides comprising the C-terminal extension peptide of Exendin-4 (e.g., SEQ ID NO: 78 or SEQ ID NO: 79), substitution of the native threonine residue at position 29 with glycine dramatically increases GLP-1 receptor activity. This amino acid substitution can be used in conjunction with other modifications disclosed herein with regard to Class 3 glucagon related peptides to enhance the affinity of the glucagon analogs for the GLP-1 receptor. For example, the T29G substitution can be combined with the S16E and N20K amino acid substitutions, optionally with a lactam bridge between amino acids 16 and 20, and optionally with addition of a PEG chain as described herein.

In some embodiments, a Class 3 glucagon related peptide comprises the sequence of SEQ ID NO: 121. In some embodiments, the Class 3 glucagon related peptide portion of the glucagon fusion peptide is selected from the group consisting of SEQ ID NO: 72, SEQ ID NO: 90, SEQ ID NO: 91, SEQ ID NO: 92, and SEQ ID NO: 93 wherein a PEG chain, when present at positions 17, 21, 24, or the C-terminal amino acid, or at both 21 and 24, is selected from the range of 500 to 40,000 Daltons. More particularly, in some embodiments, the Class 3 glucagon related peptide segment is selected from the group consisting of SEQ ID NO: 95, SEQ ID NO: 96, and SEQ ID NO: 122, wherein the PEG chain is selected from the range of 500 to 5,000. In some embodiments, the Class 3 glucagon related peptide is a fusion peptide comprising the sequence of SEQ ID NO: 72 and SEQ ID NO: 80 wherein the peptide of SEQ ID NO: 80 is linked to the carboxy terminus of SEQ ID NO: 72.

In accordance with some embodiments, an additional chemical modification of the Class 3 glucagon related peptide of SEQ ID NO: 98 bestows increased GLP-1 receptor potency to a point where the relative activity at the glucagon and GLP-1 receptors is virtually equivalent. Accordingly, in some embodiments, a Class 3 glucagon related peptide comprises a terminal amino acid comprising an amide group in place of the carboxylic acid group that is present on the native amino acid. The relative activity of the Class 3 glucagon related peptide at the respective glucagon and GLP-1 receptors can be adjusted by further modifications to the Class 3 glucagon related peptide to produce analogs demonstrating about 40% to about 500% or more of the activity of native glucagon at the glucagon receptor and about 20% to about 200% or more of the activity of native GLP-1 at the GLP-1 receptor, e.g. 50-fold, 100-fold or more increase relative to the normal activity of glucagon at the GLP-1 receptor.

EXEMPLARY EMBODIMENTS

In accordance with some embodiments, a glucagon analog is provided comprising the sequence of SEQ ID NO: 72, wherein said analog differs from SEQ ID NO: 72 by 1 to 3 amino acids, selected from positions 1, 2, 3, 5, 7, 10, 11, 13, 14, 17, 18, 19, 21, 24, 27, 28, and 29, wherein said glucagon related peptide exhibits at least 20% of the activity of native GLP-1 at the GLP-1 receptor.

In accordance with some embodiments a glucagon/GLP-1 receptor co-agonist is provided comprising the sequence: NH2-His-Ser-Gln-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 81) wherein the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu, the Xaa at position 28 is Asn, Lys or an acidic amino acid, the Xaa at position 29 is Thr, Gly or an acidic amino acid, and R is COOH or CONH2, with the proviso that when position 16 is serine, position 20 is Lys, or alternatively when position 16 is serine the position 24 is Glu and either position 20 or position 28 is Lys. In some embodiments the glucagon/GLP-1 receptor co-agonist comprises the sequence of SEQ ID NO: 81 wherein the amino acid at position 28 is aspartic acid and the amino acid at position 29 is glutamic acid. In another embodiment the amino acid at position 28 is the native asparagine, the amino acid at position 29 is glycine and the amino acid sequence of SEQ ID NO: 79 or SEQ ID NO: 80 is covalently linked to the carboxy terminus of SEQ ID NO: 81.

In some embodiments a co-agonist is provided comprising the sequence of SEQ ID NO: 81 wherein an additional acidic amino acid added to the carboxy terminus of the peptide. In a further embodiment the carboxy terminal amino acid of the glucagon analog has an amide in place of the carboxylic acid group of the natural amino acid. In some embodiments the glucagon analog comprises a sequence selected from the group consisting of SEQ ID NO: 85, SEQ ID NO: 86, SEQ ID NO: 87, and SEQ ID NO: 88.

In accordance with some embodiments a glucagon related peptide analog of SEQ ID NO: 81 is provided, wherein said analog differs from SEQ ID NO: 81 by 1 to 3 amino acids, selected from positions 1, 2, 3, 5, 7, 10, 11, 13, 14, 17, 18, 19, 21 and 27, with the proviso that when the amino acid at position 16 is serine, either position 20 is lysine, or a lactam bridge is formed between the amino acid at position 24 and either the amino acid at position 20 or position 28. In accordance with some embodiments the analog differs from SEQ ID NO: 81 by 1 to 3 amino acids selected from positions 1, 2, 3, 21 and 27. In some embodiments the glucagon peptide analog of SEQ ID NO: 81 differs from that sequence by 1 to 2 amino acids, or in some embodiments by a single amino acid, selected form positions 1, 2, 3, 5, 7, 10, 11, 13, 14, 17, 18, 19, 21 and 27, with the proviso that when the amino acid at position 16 is serine, either position 20 is lysine, or a lactam bridge is formed between the amino acid at position 24 and either the amino acid at position 20 or position 28.

In accordance with another embodiment a relatively selective GLP-1 receptor agonist is provided comprising the sequence NH2-His-Ser-Xaa-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 83) wherein the Xaa at position 3 is selected from the group of amino acids consisting of Glu, Orn or Nle, the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu, the Xaa at position 28 is Asn, Lys or an acidic amino acid, the Xaa at position 29 is Thr, Gly or an acidic amino acid, and R is COOH, CONH2, SEQ ID NO: 78 or SEQ ID NO: 79, with the proviso that when position 16 is serine, position 20 is Lys, or alternatively when position 16 is serine the position 24 is Glu and either position 20 or position 28 is Lys. In some embodiments the amino acid at position 3 is glutamic acid. In some embodiments the acidic amino acid substituted at position 28 and/or 29 is aspartic acid or glutamic acid.

In some embodiments the glucagon related peptide, including a co-agonist peptide, comprises the sequence of SEQ ID NO: 81 further comprising an additional acidic amino acid added to the carboxy terminus of the peptide. In a further embodiment the carboxy terminal amino acid of the glucagon analog has an amide in place of the carboxylic acid group of the natural amino acid.

In accordance with some embodiments a glucagon/GLP-1 receptor co-agonist is provided comprising a modified glucagon related peptide selected from the group consisting of:
NH2-His-Ser-Gln-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 82), wherein the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu and the Xaa at position 28 is Asn, Asp or Lys, R is COOH or CONH2, the Xaa at position 29 is Thr or Gly, and R is COOH, CONH2, SEQ ID NO: 78 or SEQ ID NO: 79, with the proviso that when position 16 is serine, position 20 is Lys, or alternatively when position 16 is serine the position 24 is Glu and either position 20 or position 28 is Lys. In some embodiments R is CONH2, the Xaa at position 15 is Asp, the Xaa at position 16 is selected from the group of amino acids consisting of Glu, Gln, homoglutamic acid and homocysteic acid, the Xaas at positions 20 and 24 are each Gln the Xaa at position 28 is Asn or Asp and the Xaa at position 29 is Thr. In some embodiments the Xaas at positions 15 and 16 are each Glu, the Xaas at positions 20 and 24 are each Gln, the Xaa at position 28 is Asn or Asp, the Xaa at position 29 is Thr and R is CONH2.

It has been reported that certain positions of the native glucagon peptide can be modified while retaining at least some of the activity of the parent peptide. Accordingly, applicants anticipate that one or more of the amino acids located at positions at positions 2, 5, 7, 10, 11, 12, 13, 14, 17, 18, 19, 20, 21, 24, 27, 28 or 29 of the peptide of SEQ ID NO: 99 can be substituted with an amino acid different from that present in the native glucagon peptide, and still retain activity at the glucagon receptor. In some embodiments the methionine residue present at position 27 of the native peptide is changed to leucine or norleucine to prevent oxidative degradation of the peptide. In another embodiment the amino acid at position 20 is substituted with Lys, Arg, Orn or Citrullene and/or position 21 is substituted with Glu, homoglutamic acid or homocysteic acid.

In some embodiments a glucagon analog of SEQ ID NO: 108 is provided wherein 1 to 6 amino acids, selected from positions 1, 2, 5, 7, 10, 11, 13, 14, 17, 18, 19, 21, 27, 28 or 29 of the analog differ from the corresponding amino acid of SEQ ID NO: 701, with the proviso that when the amino acid at position 16 is serine, position 20 is Lys, or alternatively when position 16 is serine the position 24 is Glu and either position 20 or position 28 is Lys. In accordance with another embodiment a glucagon analog of SEQ ID NO: 108 is provided wherein 1 to 3 amino acids selected from positions 1, 2, 5, 7, 10, 11, 13, 14, 17, 18, 19, 20, 21, 27, 28 or 29 of the analog differ from the corresponding amino acid of SEQ ID NO: 701. In another embodiment, a glucagon analog of SEQ ID NO: 96, SEQ ID NO: 97 or SEQ ID NO: 99 is provided wherein 1 to 2 amino acids selected from positions 1, 2, 5, 7, 10, 11, 13, 14, 17, 18, 19, 20 or 21 of the analog differ from the corresponding amino acid of SEQ ID NO: 701, and in a further embodiment the one to two differing amino acids represent conservative amino acid substitutions relative to the amino acid present in the native glucagon sequence (SEQ ID NO: 701). In some embodiments a glucagon peptide of SEQ ID NO: 100, SEQ ID NO: 101, SEQ ID NO: 102 or SEQ ID NO: 103 is provided wherein the glucagon peptide further comprises one, two or three amino acid substitutions at positions selected from positions 2, 5, 7, 10, 11, 13, 14, 17, 18, 19, 20, 21, 27 or 29. In some embodiments the substitutions at positions 2, 5, 7, 10, 11, 13, 14, 16, 17, 18, 19, 20, 21, 27 or 29 are conservative amino acid substitutions.

In accordance with some embodiments a glucagon/GLP-1 receptor co-agonist is provided comprising a variant of the sequence of SEQ ID NO 81, wherein 1 to 10 amino acids selected from positions 16, 17, 18, 20, 21, 23, 24, 27, 28 and 29, respectively, of the variant differ from the corresponding amino acid of SEQ ID NO: 701. In accordance with some embodiments a variant of the sequence of SEQ ID NO 81 is provided wherein the variant differs from SEQ ID NO: 81 by one or more amino acid substitutions selected from the group consisting of Gln17, Ala18, Glu21, Ile23, Ala24, Va127 and Gly29. In accordance with some embodiments a glucagon/GLP-1 receptor co-agonist is provided comprising variants of the sequence of SEQ ID NO 81, wherein 1 to 2 amino acids selected from positions 17-26 of the variant differ from the corresponding amino acid of SEQ ID NO: 701. In accordance with some embodiments a variant of the sequence of SEQ ID NO 81 is provided wherein the variant differs from SEQ ID NO: 81 by an amino acid substitution selected from the group consisting of Gln17, Ala18, Glu21, Ile23 and Ala24. In accordance with some embodiments a variant of the sequence of SEQ ID NO 81 is provided wherein the variant differs from SEQ ID NO: 81 by an amino acid substitution at position 18 wherein the substituted amino acid is selected from the group consisting of Ala, Ser, Thr, and Gly. In accordance with some embodiments a variant of the sequence of SEQ ID NO 81 is provided wherein the variant differs from SEQ ID NO: 81 by an amino acid substitution of Ala at position 18. Such variations are encompassed by SEQ ID NO: 72. In another embodiment a glucagon/GLP-1 receptor co-agonist is provided comprising variants of the sequence of SEQ ID NO 81, wherein 1 to 2 amino acids selected from positions 17-22 of the variant differ from the corresponding amino acid of SEQ ID NO: 701, and in a further embodiment a variant of SEQ ID NO 81 is provided wherein the variant differs from SEQ ID NO: 81 by 1 or 2 amino acid substitutions at positions 20 and 21.

In accordance with some embodiments a glucagon/GLP-1 receptor co-agonist is provided comprising the sequence: NH2-His-Ser-Gln-Gly-Thr-Phe-Thr-Ser-Asp-Tyr-Ser-Lys-Tyr-Leu-Xaa-Xaa-Arg-Arg-Ala-Xaa-Xaa-Phe-Val-Xaa-Trp-Leu-Met-Xaa-Xaa-R (SEQ ID NO: 123), wherein the Xaa at position 15 is Asp, Glu, cysteic acid, homoglutamic acid or homocysteic acid, the Xaa at position 16 is Ser, Glu, Gln, homoglutamic acid or homocysteic acid, the Xaa at position 20 is Gln, Lys, Arg, Orn or citrulline, the Xaa at position 21 is Asp, Glu, homoglutamic acid or homocysteic acid, the Xaa at position 24 is Gln or Glu, the Xaa at position 28 is Asn, Lys or an acidic amino acid, the Xaa at position 29 is Thr or an acid amino acid and R is COOH or CONH$_2$. In some embodiments R is CONH$_2$. In accordance with some embodiments a glucagon/GLP-1 receptor co-agonist is provided comprising a variant of SEQ ID NO: 99, SEQ ID NO: 100, SEQ ID NO: 101, SEQ ID NO: 102, SEQ ID NO: 103, SEQ ID NO: 114, SEQ ID NO: 115 or SEQ ID NO: 116, wherein the variant differs from said sequence by an amino acid substitution at position 20. In some embodiments the amino acid substitution is selected form the group consisting of Lys, Arg, Orn or citrulline for position 20.

In some embodiments a glucagon agonist is provided comprising an analog peptide of SEQ ID NO: 82 wherein the analog differs from SEQ ID NO: 82 by having an amino acid other than serine at position 2. In some embodiments the serine residue is substituted with aminoisobutyric acid, D-alanine, and in some embodiments the serine residue is substituted with aminoisobutyric acid. Such modifications suppresses cleavage by dipeptidyl peptidase IV while retaining the inherent potency of the parent compound (e.g. at least 75, 80, 85, 90, 95% or more of the potency of the parent compound). In some embodiments the solubility of the analog is increased, for example, by introducing one, two, three or more charged amino acid(s) to the C-terminal portion of native glucagon, preferably at a position C-terminal to position 27. In exemplary embodiments, one, two, three or all of the charged amino acids are negatively charged. In another embodiment the analog further comprises an acidic amino acid substituted for the native amino acid at position 28 or 29 or an acidic amino acid added to the carboxy terminus of the peptide of SEQ ID NO: 82.

In some embodiments the glucagon analogs disclosed herein are further modified at position 1 or 2 to reduce susceptibility to cleavage by dipeptidyl peptidase IV. In some embodiments a glucagon analog of SEQ ID NO: 97, SEQ ID NO: 99, SEQ ID NO: 100, SEQ ID NO: 101, SEQ ID NO: 102 or SEQ ID NO: 103 is provided wherein the analog differs from the parent molecule by a substitution at position 2 and exhibits reduced susceptibility (i.e., resistance) to cleavage by dipeptidyl peptidase IV. More particularly, in some embodiments position 2 of the analog peptide is substituted with an amino acid selected from the group consisting of D-serine, D-alanine, valine, amino n-butyric acid, glycine, N-methyl serine and aminoisobutyric acid. In some embodiments position 2 of the analog peptide is substituted with an amino acid selected from the group consisting of D-serine, D-alanine, glycine, N-methyl serine and aminoisobutyric acid. In another embodiment position 2 of the analog peptide is substituted with an amino acid selected from the group consisting of D-serine, glycine, N-methyl serine and aminoisobutyric acid. In some embodiments the amino acid at position 2 is not D-serine. In some embodiments the glucagon related peptide comprises the sequence of SEQ ID NO: 127 or SEQ ID NO: 128.

In some embodiments a glucagon analog of SEQ ID NO: 97, SEQ ID NO: 99, SEQ ID NO: 100, SEQ ID NO: 101, SEQ ID NO: 102 or SEQ ID NO: 103 is provided wherein the analog differs from the parent molecule by a substitution at position 1 and exhibits reduced susceptibility (i.e., resistance) to cleavage by dipeptidyl peptidase IV. More particularly, position 1 of the analog peptide is substituted with an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. In another embodiment a glucagon agonist is provided comprising an analog peptide of SEQ ID NO: 82 wherein the analog differs from SEQ ID NO: 82 by having an amino acid other than histidine at position 1. In some embodiments the solubility of the analog is increased, for example, by introducing one, two, three or more charged amino acid(s) to the C-terminal portion of native glucagon, preferably at a position C-terminal to position 27. In exemplary embodiments, one, two, three or all of the charged amino acids are negatively charged. In another embodiment the analog further comprises an acidic amino acid substituted for the native amino acid at position 28 or 29 or an acidic amino acid added to the carboxy terminus of the peptide of SEQ ID NO: 82. In some embodiments the acidic amino acid is aspartic acid or glutamic acid.

In some embodiments the glucagon/GLP-1 receptor co-agonist comprises a sequence of SEQ ID NO: 108 further comprising an additional carboxy terminal extension of one amino acid or a peptide selected from the group consisting of SEQ ID NO: 78, SEQ ID NO: 117 and SEQ ID NO: 118. In the embodiment wherein a single amino acid is added to the carboxy terminus of SEQ ID NO: 108, the amino acid is typically selected from one of the 20 common amino acids, and in some embodiments the additional carboxy terminus amino acid has an amide group in place of the carboxylic acid of the native amino acid. In some embodiments the additional amino acid is selected from the group consisting of glutamic acid, aspartic acid and glycine.

In an alternative embodiment a glucagon/GLP-1 receptor co-agonist is provided wherein the peptide comprises at least one lactam ring formed between the side chain of a glutamic acid residue and a lysine residue, wherein the glutamic acid residue and a lysine residue are separated by three amino acids. In some embodiments the carboxy terminal amino acid of the lactam bearing glucagon peptide has an amide group in place of the carboxylic acid of the native amino acid. More particularly, in some embodiments a glucagon and GLP-1 co-agonist is provided comprising a modified glucagon peptide selected from the group consisting of:

```
                                             (SEQ ID NO: 66)
NH2-His-Ser-Gln-Gly-Thr-Phe-Thr-Ser-Asp-Tyr-Ser-

Lys-Tyr-Leu-Asp-Glu-Arg-Arg-Ala-Gln-Asp-Phe-Val-

Gln-Trp-Leu-Met-Xaa-Xaa-R (SEQ ID NO: 109)
NH2-His-Ser-Gln-Gly-Thr-Phe-Thr-Ser-Asp-Tyr-Ser-

Lys-Tyr-Leu-Asp-Glu-Arg-Arg-Ala-Lys-Asp-Phe-Val-

Gln-Trp-Leu-Met-Xaa-Xaa-R (SEQ ID NO: 111)
NH2-His-Ser-Gln-Gly-Thr-Phe-Thr-Ser-Asp-Tyr-Ser-

Lys-Tyr-Leu-Asp-Ser-Arg-Arg-Ala-Lys-Asp-Phe-Val-

Glu-Trp-Leu-Met-Xaa-Xaa-R (SEQ ID NO: 112)
NH2-His-Ser-Gln-Gly-Thr-Phe-Thr-Ser-Asp-Tyr-Ser-

Lys-Tyr-Leu-Asp-Ser-Arg-Arg-Ala-Gln-Asp-Phe-Val-

Glu-Trp-Leu-Met-Lys-Xaa-R (SEQ ID NO: 104)
NH2-His-Ser-Gln-Gly-Thr-Phe-Thr-Ser-Asp-Tyr-Ser-

Lys-Tyr-Leu-Asp-Glu-Arg-Arg-Ala-Lys-Asp-Phe-Val-

Glu-Trp-Leu-Met-Asn-Thr-R (SEQ ID NO: 105)
NH2-His-Ser-Gln-Gly-Thr-Phe-Thr-Ser-Asp-Tyr-Ser-

Lys-Tyr-Leu-Asp-Glu-Arg-Arg-Ala-Gln-Asp-Phe-Val-

Glu-Trp-Leu-Met-Lys-Thr-R (SEQ ID NO: 106)
NH2-His-Ser-Gln-Gly-Thr-Phe-Thr-Ser-Asp-Tyr-Ser-

Lys-Tyr-Leu-Asp-Glu-Arg-Arg-Ala-Lys-Asp-Phe-Val-

Glu-Trp-Leu-Met-Lys-Thr-R
``` wherein Xaa at position 28=Asp, or Asn, the Xaa at position 29 is Thr or Gly, R is selected from the group consisting of COOH, CONH2, glutamic acid, aspartic acid, glycine, SEQ ID NO: 78, SEQ ID NO: 117 and SEQ ID NO: 118, and a lactam bridge is formed between Lys at position 12 and Glu at position 16 for SEQ ID NO: 109, between Glu at position 16 and Lys at position 20 for SEQ ID NO: 110, between Lys at position 20 and Glu at position 24 for SEQ ID NO: 111, between Glu at position 24 and Lys at position 28 for SEQ ID NO: 112, between Lys at position 12 and Glu at position 16 and between Lys at position 20 and Glu at position 24 for SEQ ID NO: 104, between Lys at position 12 and Glu at position 16 and between Glu at position 24 and Lys at position 28 for SEQ ID NO: 105 and between Glu at position 16 and Lys at position 20 and between Glu at position 24 and Lys at position 28 for SEQ ID NO: 106. In some embodiments R is selected from the group consisting of COOH, CONH$_2$, glutamic acid, aspartic acid, glycine, the amino acid at position 28 is Asn, and the amino acid at position 29 is threonine. In some embodiments R is CONH$_2$, the amino acid at position 28 is Asn and the amino acid at position 29 is threonine. In another embodiment R is selected from the group consisting of SEQ ID NO: 78, SEQ ID NO: 79 and SEQ ID NO: 80 and the amino acid at position 29 is glycine.

In a further embodiment the glucagon/GLP-1 receptor co-agonist is selected from the group consisting of SEQ ID NO: 99, SEQ ID NO: 100, SEQ ID NO: 101, SEQ ID NO: 102, SEQ ID NO: 103, SEQ ID NO: 104, SEQ ID NO: 105 and SEQ ID NO: 106, wherein the peptide further comprises an additional carboxy terminal extension of one amino acid or a peptide selected from the group consisting of SEQ ID NO: 78, SEQ ID NO: 117 and SEQ ID NO: 118. In some embodiments the terminal extension comprises the sequence of SEQ ID NO: 78, SEQ ID NO: 79 or SEQ ID NO: 80 and the glucagon related peptide comprises the sequence of SEQ ID NO: 72. In some embodiments the glucagon/GLP-1 receptor co-agonist comprises the sequence of SEQ ID NO: 81 wherein the amino acid at position 16 is glutamic acid, the amino acid at position 20 is lysine, the amino acid at position 28 is asparagine and the amino acid sequence of SEQ ID No: 78 or SEQ ID NO: 79 is linked to the carboxy terminus of SEQ ID NO: 81.

In the embodiment wherein a single amino acid is added to the carboxy terminus of SEQ ID NO: 108, the amino acid is typically selected from one of the 20 common amino acids, and in some embodiments the amino acid has an amide group in place of the carboxylic acid of the native amino acid. In some embodiments the additional amino acid is selected from the group consisting of glutamic acid and aspartic acid and glycine. In the embodiments wherein the glucagon agonist analog further comprises a carboxy terminal extension, the carboxy terminal amino acid of the extension, in some embodiments, ends in an amide group or an ester group rather than a carboxylic acid.

In another embodiment the glucagon/GLP-1 receptor co-agonist comprises the sequence: NH$_2$-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Gln-Trp-Leu-Met-Asn-Thr-Xaa-CONH$_2$ (SEQ ID NO: 107), wherein the Xaa at position 30 represents any amino acid. In some embodiments Xaa is selected from one of the 20 common amino acids, and in some embodiments the amino acid is glutamic acid, aspartic acid or glycine. The solubility of this peptide can be further improved by covalently linking a PEG chain to the side chain of amino acid at position 17, 21, 24 or 30 of SEQ ID NO: 107. In a further embodiment the peptide comprises an additional carboxy terminal extension of a peptide selected from the group consisting of SEQ ID NO: 78, SEQ ID NO: 117 and SEQ ID NO: 118. In accordance with some embodiments the glucagon/GLP-1 receptor co-agonist comprises the sequence of SEQ ID NO: 129, SEQ ID NO: 130 and SEQ ID NO: 131.

Additional site specific modifications internal to the glucagon sequence of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107 and SEQ ID NO: 121 can be made to yield a set of glucagon agonists that possess variable degrees of GLP-1 agonism. Accordingly, peptides that possess virtually identical in vitro potency at each receptor have been prepared and characterized. Similarly, peptides with tenfold selectively enhanced potency at each of the two receptors have been identified and characterized. As noted above substitution of the serine residue at position 16 with glutamic acid enhances the potency of native glucagon at both the Glucagon and GLP-1 receptors, but maintains approximately a tenfold selectivity for the glucagon receptor. In addition by substituting the native glutamine at position 3 with glutamic acid (SEQ ID NO: 128) generates a glucagon analog that exhibits approximately a tenfold selectivity for the GLP-1 receptor.

The solubility of the glucagon/GLP-1 co-agonist peptides can be further enhanced in aqueous solutions at physiological pH, while retaining the high biological activity relative to native glucagon by the introduction of hydrophilic groups at positions 16, 17, 21, and 24 of the peptide, or by the addition of a single modified amino acid (i.e., an amino acid modified to comprise a hydrophilic group) at the carboxy terminus of the glucagon/GLP-1 co-agonist peptide. In accordance with some embodiments the hydrophilic group comprises a polyethylene (PEG) chain. More particularly, in some embodiments the glucagon peptide comprises the sequence of SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105 or SEQ ID NO: 106 wherein a PEG chain is covalently linked to the side chain of an amino acids at position 16, 17, 21, 24, 29 or the C-terminal amino acid of the glucagon peptide, with the proviso that when the peptide comprises SEQ ID NO: 98, SEQ ID NO: 99, SEQ ID NO: 100 or SEQ ID NO: 101 the polyethylene glycol chain is covalently bound to an amino acid residue at position 17, 21 or 24, when the peptide comprises SEQ ID NO: 102 or SEQ ID NO: 103 the polyethylene glycol chain is covalently bound to an amino acid residue at position 16, 17 or 21, and when the peptide comprises SEQ ID NO: 104, SEQ ID NO: 105 or SEQ ID NO: 106 the polyethylene glycol chain is covalently bound to an amino acid residue at position 17 or 21.

In some embodiments the glucagon peptide comprises the sequence of SEQ ID NO: 99, SEQ ID NO: 100 or SEQ ID NO: 101, wherein a PEG chain is covalently linked to the side chain of an amino acids at position 17, 21, 24, or the C-terminal amino acid of the glucagon peptide, and the carboxy terminal amino acid of the peptide has an amide group in place of the carboxylic acid group of the native amino acid. In some embodiments the glucagon/GLP-1 receptor co-agonist peptide comprises a sequence selected from the group consisting of SEQ ID NO: 100, SEQ ID NO: 101, SEQ ID NO: 102, SEQ ID NO: 103, SEQ ID NO: 104, SEQ ID NO: 105, SEQ ID NO: 106 and SEQ ID NO: 107, wherein a PEG chain is covalently linked to the side chain of an amino acid at position 17, 21 or 24 of SEQ ID NO: 100, SEQ ID NO: 101 and SEQ ID NO: 107, or at position 16, 17 or 21 of SEQ ID NO: 102 and SEQ ID NO: 103 or at position 17 or 21 of SEQ ID NO: 104, SEQ ID NO: 105 and SEQ ID NO: 106 of the glucagon peptide. In another embodiment the glucagon/GLP-1 receptor co-agonist peptide comprises the sequence of SEQ ID NO: 99 or SEQ ID NO: 107, wherein a PEG chain is covalently linked to the side chain of an amino acids at position 17, 21 or 24 or the C-terminal amino acid of the glucagon peptide.

In some embodiments a glucagon peptide selected from the group consisting of SEQ ID NO: 100, SEQ ID NO: 101, SEQ ID NO: 102, SEQ ID NO: 103, SEQ ID NO: 104, SEQ ID NO: 105, SEQ ID NO: 106, and SEQ ID NO: 107 is further modified to comprise a PEG chain covalently linked to the side chain of an amino acid at position 17 or 21 of the glucagon peptide. In some embodiments the pegylated glucagon/GLP-1 receptor co-agonist further comprises the sequence of SEQ ID NO: 78, SEQ ID NO: 117 or SEQ ID NO: 79.

In another embodiment the glucagon related peptide comprises the sequence of SEQ ID NO: 72 or SEQ ID NO: 120, further comprising a C-terminal extension of SEQ ID NO: 78, SEQ ID NO: 79 or SEQ ID NO: 80 linked to the C-terminal amino acid of SEQ ID NO: 72 or SEQ ID NO: 120, and optionally further comprising a PEG chain covalently linked to the side chain of an amino acids at position 17, 18, 21, 24 or 29 or the C-terminal amino acid of the peptide. In another embodiment the glucagon related peptide comprises the sequence of SEQ ID NO: 72 or SEQ ID NO: 120, wherein a PEG chain is covalently linked to the side chain of an amino acids at position 21 or 24 of the glucagon related peptide and the peptide further comprises a C-terminal extension of SEQ ID NO: 78, or SEQ ID NO: 79.

In another embodiment the glucagon related peptide comprises the sequence of SEQ ID NO: 72, or SEQ ID NO: 81 or SEQ ID NO: 82, wherein an additional amino acid is added to the carboxy terminus of SEQ ID NO: 81 or SEQ ID NO: 82, and a PEG chain is covalently linked to the side chain of the added amino acid. In a further embodiment, the pegylated glucagon analog further comprises a C-terminal extension of SEQ ID NO: 78 or SEQ ID NO: 79 linked to the C-terminal amino acid of SEQ ID NO: 81 or SEQ ID NO: 82. In another embodiment the glucagon related peptide comprises the sequence of SEQ ID NO: 107, wherein a PEG chain is covalently linked to the side chain of the amino acid at position 30 of the glucagon related peptide and the peptide further comprises a C-terminal extension of SEQ ID NO: 78 or SEQ ID NO: 79 linked to the C-terminal amino acid of SEQ ID NO: 107.

The polyethylene glycol chain may be in the form of a straight chain or it may be branched. In accordance with some embodiments the polyethylene glycol chain has an average molecular weight selected from the range of about 500 to about 10,000 Daltons. In some embodiments the polyethylene glycol chain has an average molecular weight selected from the range of about 1,000 to about 5,000 Daltons. In an alternative embodiment the polyethylene glycol chain has an average molecular weight selected from the range of about 10,000 to about 20,000 Daltons. In accordance with some embodiments the pegylated glucagon related peptide comprises two or more polyethylene glycol chains covalently bound to the glucagon related peptide wherein the total molecular weight of the glucagon chains is about 1,000 to about 5,000 Daltons. In some embodiments the pegylated glucagon agonist comprises a peptide consisting of SEQ ID NO: 93 or a glucagon agonist analog of SEQ ID NO: 93, wherein a PEG chain is covalently linked to the amino acid residue at position 21 and at position 24, and wherein the combined molecular weight of the two PEG chains is about 1,000 to about 5,000 Daltons.

In certain exemplary embodiments, the glucagon peptide comprises the amino acid sequence of SEQ ID NO: 701 with up to ten amino acid modifications and comprises an amino acid at position 10 which is acylated or alkylated. In some embodiments, the amino acid at position 10 is acylated or alkylated with a C4 to C30 fatty acid. In certain aspects, the amino acid at position 10 comprises an acyl group or an alkyl group which is non-native to a naturally-occurring amino acid.

In certain embodiments, the glucagon peptide comprising an amino acid at position 10 which is acylated or alkylated comprises a stabilized alpha helix. Accordingly, in certain aspects, the glucagon peptide comprises an acyl or alkyl group as described herein and an intramolecular bridge, e.g., a covalent intramolecular bridge (e.g., a lactam bridge) between the side chains of an amino acid at position i and an amino acid at position i+4, wherein i is 12, 16, 20, or 24. Alternatively or additionally, the glucagon peptide comprises an acyl or alkyl group as described herein and one, two, three or more of positions 16, 20, 21 and/or 24 of the glucagon peptide are substituted with an α, α-disubstituted amino acid, e.g., AIB. In some instances, the non-native glucagon peptide comprises Glu at position 16 and Lys at position 20, wherein optionally a lactam bridge links the Glu and the Lys, and, optionally, the glucagon peptide further comprises one or more modifications selected from the group consisting of: Gln at position 17, Ala at position 18, Glu at position 21, Ile at position 23, and Ala at position 24.

Also, in any of the embodiments, wherein the glucagon related peptide comprises an amino acid at position 10 which is acylated or alkylated, the glucagon related peptide can further comprise a C-terminal amide in lieu of the C-terminal alpha carboxylate.

In some embodiments, the glucagon related peptide comprising an acyl or alkyl group as described herein further comprises an amino acid substitution at position 1, at position 2, or at positions 1 and 2, wherein the amino acid substitution(s) achieve DPP-IV protease resistance. In certain specific embodiments, the glucagon related peptide is one which comprises SEQ ID NOs: 72 with an amino acid at position 10 acylated or alkylated as described herein. The acyl or alkyl group of these embodiments may be any acyl or alkyl group described herein. For example, the acyl group may be a C4 to C30 (e.g., C8 to C24) fatty acyl group and the alkyl group may be a C4 to C30 (e.g., C8 to C24) alkyl group.

The amino acid to which the acyl or alkyl group is attached may be any of the amino acids described herein, e.g., an amino acid of any of Formula I (e.g., Lys), Formula II, and Formula III.

In some embodiments, the acyl group or alkyl group is directly attached to the amino acid at position 10. In some embodiments, the acyl or alkyl group is attached to the amino acid at position 10 via a spacer, such as, for example, a spacer which is 3 to 10 atoms in length, e.g., an amino acid or dipeptide. Suitable spacers for purposes of attaching an acyl or alkyl group are described herein.

In certain aspects, the glucagon analogs comprise at least one amino acid modification and up to 15 amino acid modifications (e.g., 1, 2, 3, 4, 5, 6, 7, 8, 9, 10, 11, 12, 13, 14, 15 amino acid modifications), or up to 10 amino acid modifications. In certain embodiments, the analogs comprising at least one amino acid modification and up to 10 amino acid modifications represent conservative amino acid modifications. Conservative amino acid modifications are described herein.

Accordingly, in some aspects, the glucagon analog comprises the amino acid sequence of SEQ ID NO: 701 with one or more of: Gln at position 17, Ala at position 18, Glu at position 21, Ile at position 23, and Ala or Cys at position 24, or conservative amino acid substitutions thereof. In some aspects, the analog comprises a C-terminal amide in place of the C-terminal alpha carboxylate. In certain embodiments, the analog comprises an amino acid substitution at position 1, position 2, or positions 1 and 2, which substitution(s) achieve DPP-IV protease resistance. Suitable amino acid substitutions are described herein. For example, DMIA at position 1 and/or d-Ser or AIB at position 2. In some embodiments, the amino acid at position 2 is not D-serine.

Additionally or alternatively, the analog may comprise one or a combination of: (a) Ser at position 2 substituted with Ala; (b) Gln at position 3 substituted with Glu or a glutamine analog; (c) Thr at position 7 substituted with a Ile;

(d) Tyr at position 10 substituted with Trp or an amino acid comprising an acyl or alkyl group which is non-native to a naturally-occurring amino acid; (e) Lys at position 12 substituted with Ile; (f) Asp at position 15 substituted with Glu; (g) Ser at position 16 substituted with Glu; (h) Gln at position 20 substituted with Ser, Thr, Ala, AIB; (i) Gln at position 24 substituted with Ser, Thr, Ala, AIB; (j) Met at position 27 substituted with Leu or Nle; (k) Asn at position 29 substituted with a charged amino acid, optionally, Asp or Glu; and (l) Thr at position 29 substituted with Gly or a charged amino acid, optionally, Asp or Glu. In certain aspects, the analog comprises the amino acid sequence of any of SEQ ID NOs: 657-669.

With regard to the analogs which exhibit agonist activity at the GIP receptor, the analog comprises an extension of 1-21 amino acids (e.g., 5-19, 7-15, 9-12 amino acids). The extension of the analog may comprise any amino acid sequence, provided that the extension is 1 to 21 amino acids. In some aspects, the extension is 7 to 15 amino acids and in other aspects, the extension is 9 to 12 amino acids. In some embodiments, the extension comprises (i) the amino acid sequence of SEQ ID NO: 78 or 674, (ii) an amino acid sequence which has high sequence identity (e.g., at least 80%, 85%, 90%, 95%, 98%, 99%) with the amino acid sequence of SEQ ID NO: 78 or 674, or (iii) the amino acid sequence of (i) or (ii) with one or more conservative amino acid modifications.

In some embodiments, at least one of the amino acids of the extension is acylated or alkylated. The amino acid comprising the acyl or alkyl group may be located at any position of extension of the analog. In certain embodiments, the acylated or alkylated amino acid of the extension is located at one of positions 37, 38, 39, 40, 41, or 42 (according to the numbering of SEQ ID NO: 701) of the analog. In certain embodiments, the acylated or alkylated amino acid is located at position 40 of the analog.

In exemplary embodiments, the acyl or alkyl group is an acyl or alkyl group which is non-native to a naturally-occurring amino acid. For example, the acyl or alkyl group may be a C4 to C30 (e.g., C12 to C18) fatty acyl group or C4 to C30 (e.g., C12 to C18) alkyl. The acyl or alkyl group may be any of those discussed herein.

In some embodiments, the acyl or alkyl group is attached directly to the amino acid, e.g., via the side chain of the amino acid. In other embodiments, the acyl or alkyl group is attached to the amino acid via a spacer (e.g., an amino acid, a dipeptide, a tripeptide, a hydrophilic bifunctional spacer, a hydrophobic bifunctional spacer). In certain aspects, the spacer is 3 to 10 atoms in length. In some embodiments, the amino acid spacer is not γ-Glu. In some embodiments, the dipeptide spacer is not γ-Glu-γ-Glu.

Also, in exemplary embodiments, the amino acid to which the acyl or alkyl group is attached may be any of those described herein, including, for example, an amino acid of Formula I, II, or III. The amino acid which is acylated or alkylated may be a Lys, for example. Suitable amino acids comprising an acyl or alkyl group, as well as suitable acyl groups and alkyl groups, are described herein. See, for example, the teachings under the sections entitled Acylation and Alkylation.

In other embodiments, 1-6 amino acids (e.g., 1-2, 1-3, 1-4, 1-5 amino acids) of the extension are positive-charged amino acids, e.g., amino acids of Formula IV, such as, for example, Lys. As used herein, the term "positive-charged amino acid" refers to any amino acid, naturally-occurring or non-naturally occurring, comprising a positive charge on an atom of its side chain at a physiological pH. In certain aspects, the positive-charged amino acids are located at any of positions 37, 38, 39, 40, 41, 42, and 43. In specific embodiments, a positive-charged amino acid is located at position 40. In other instances, the extension is acylated or alkylated as described herein and comprises 1-6 positive charged amino acids as described herein.

In yet other embodiments, the analogs which exhibit agonist activity at the GIP receptor comprises (i) SEQ ID NO: 701 with at least one amino acid modification, (ii) an extension of 1 to 21 amino acids (e.g., 5 to 18, 7 to 15, 9 to 12 amino acids) C-terminal to the amino acid at position 29 of the analog, and (iii) an amino acid comprising an acyl or alkyl group which is non-native to a naturally-occurring amino acid which is located outside of the C-terminal extension (e.g., at any of positions 1-29). In some embodiments, the analog comprises an acylated or alkylated amino acid at position 10. In particular aspects, the acyl or alkyl group is a C4 to C30 fatty acyl or C4 to C30 alkyl group. In some embodiments, the acyl or alkyl group is attached via a spacer, e.g., an amino acid, dipeptide, tripeptide, hydrophilic bifunctional spacer, hydrophobic bifunctional spacer). In certain aspects, the analog comprises an amino acid modification which stabilizes the alpha helix, such as a salt bridge between a Glu at position 16 and a Lys at position 20, or an alpha, alpha-disubstituted amino acid at any one, two, three, or more of positions 16, 20, 21, and 24. In specific aspects, the analog additionally comprises amino acid modifications which confer DPP-IV protease resistance, e.g., DMIA at position 1, AIB at position 2. Analogs comprising further amino acid modifications are contemplated herein. In one embodiment the Class 3 glucagon related peptide comprises the structures of any of SEQ ID NOs: 657-669.

In accordance with some embodiments, the Class 3 glucagon related peptide comprises the amino acid sequence of native glucagon (SEQ ID NO: 701) comprising the following modifications: AIB at position 2, Glu at position 3, Lys at position 10, Glu at position 16, Gln at position 17, Ala at position 18, Lys at position 20, Glu at position 21, Ile at position 23, Ala at position 24; wherein Lys at position 10 is acylated with a C14 or C16 fatty acid, and wherein the C-terminal carboxylate is replaced with an amide. In a specific embodiment, this Class 3 glucagon related peptide is attached via its N-terminal amino acid to the dipeptide D-Lys-Sarcosine.

In accordance with some embodiments, the Class 3 glucagon related peptide comprises, consists essentially of, or consists of an amino acid sequence of any of SEQ ID NOs: 514, 517-534, or 554, optionally with up to 1, 2, 3, 4, or 5 further modifications that retain GLP-1 agonist and/or glucagon agonist activity. In certain embodiments, the Class 3 glucagon related peptide comprises the amino acids of any of SEQ ID NOs: 562-684, and 1701-1776. In some embodiments, the Class 3 glucagon related peptide comprises the amino acid sequences of any of SEQ ID NOs: 1801-1908.

The disclosed glucagon related peptide-insulin peptide conjugates are believed to be suitable for any use that has previously been described for insulin peptides. Accordingly, the glucagon related peptide-insulin conjugates described herein can be used to treat hyperglycemia, or treat other metabolic diseases that result from high blood glucose levels. Accordingly, the present invention encompasses pharmaceutical compositions comprising a glucagon related peptide-insulin conjugate as disclosed herein and a pharmaceutically acceptable carrier for use in treating a patient suffering from high blood glucose levels. In accordance with one embodiment the patient to be treated using a glucagon related peptide-insulin conjugate disclosed herein is a domesticated animal, and in another embodiment the patient to be treated is a human.

One method of treating hyperglycemia in accordance with the present disclosure comprises the steps of administering the presently disclosed glucagon related peptide-insulin conjugate to a patient using any standard route of administration, including parenterally, such as intravenously, intraperitoneally, subcutaneously or intramuscularly, intrathecally, transdermally, rectally, orally, nasally or by inhalation. In one embodiment the composition is administered subcutaneously or intramuscularly. In one embodiment, the composition is administered parenterally and the glucagon related peptide-insulin conjugate is prepackaged in a syringe.

The glucagon related peptide-insulin conjugate disclosed herein may be administered alone or in combination with other anti-diabetic agents. Anti-diabetic agents known in the art or under investigation include native insulin, native glucagon and functional analogs thereof, sulfonylureas, such as tolbutamide (Orinase), acetohexamide (Dymelor), tolazamide (Tolinase), chlorpropamide (Diabinese), glipizide (Glucotrol), glyburide (Diabeta, Micronase, Glynase), glimepiride (Amaryl), or gliclazide (Diamicron); meglitinides, such as repaglinide (Prandin) or nateglinide (Starlix); biguanides such as metformin (Glucophage) or phenformin; thiazolidinediones such as rosiglitazone (Avandia), pioglitazone (Actos), or troglitazone (Rezulin), or other PPARy inhibitors; alpha glucosidase inhibitors that inhibit carbohydrate digestion, such as miglitol (Glyset), acarbose (Precose/Glucobay); exenatide (Byetta) or pramlintide; Dipeptidyl peptidase-4 (DPP-4) inhibitors such as vildagliptin or sitagliptin; SGLT (sodium-dependent glucose transporter 1) inhibitors; or FBPase (fructose 1,6-bisphosphatase) inhibitors.

Pharmaceutical compositions comprising the glucagon related peptide-insulin conjugates disclosed herein can be formulated and administered to patients using standard pharmaceutically acceptable carriers and routes of administration known to those skilled in the art. Accordingly, the present disclosure also encompasses pharmaceutical compositions comprising one or more of the glucagon related peptide-insulin conjugates disclosed herein or a pharmaceutically acceptable salt thereof, in combination with a pharmaceutically acceptable carrier. In one embodiment the pharmaceutical composition comprises a 1 mg/ml concentration of the glucagon related peptide-insulin conjugate at a pH of about 4.0 to about 7.0 in a phosphate buffer system. The pharmaceutical compositions may comprise the glucagon related peptide-insulin conjugate as the sole pharmaceutically active component, or the glucagon related peptide-insulin conjugate peptide can be combined with one or more additional active agents.

All therapeutic methods, pharmaceutical compositions, kits and other similar embodiments described herein contemplate that glucagon related peptide-insulin conjugate peptides include all pharmaceutically acceptable salts thereof.

In one embodiment the kit is provided with a device for administering the glucagon related peptide-insulin conjugate to a patient. The kit may further include a variety of containers, e.g., vials, tubes, bottles, and the like. Preferably, the kits will also include instructions for use. In accordance with one embodiment the device of the kit is an aerosol dispensing device, wherein the composition is prepackaged within the aerosol device. In another embodiment the kit comprises a syringe and a needle, and in one embodiment the glucagon related peptide-insulin conjugate composition is prepackaged within the syringe.

The compounds of this invention may be prepared by standard synthetic methods, recombinant DNA techniques, or any other methods of preparing peptides and fusion proteins. Although certain non-natural amino acids cannot be expressed by standard recombinant DNA techniques, techniques for their preparation are known in the art. Compounds of this invention that encompass non-peptide portions may be synthesized by standard organic chemistry reactions, in addition to standard peptide chemistry reactions when applicable.

In accordance with embodiment 1, an insulin agonist/incretin conjugate comprising a glucagon related peptide and an insulin peptide is provided, wherein the glucagon related peptide is linked either directly or through a linker to the insulin peptide. In embodiment 2, the conjugate of embodiment 1 has the C-terminal region of the glucagon related peptides covalently linked to the insulin peptide through a position independently selected from the side chain of an amino acid at a position selected from the group consisting of A9, A14 and A15 of the A chain, positions B1, B2, B10, B22, B28 or B29 of the B chain, the N-terminal alpha amine of the B chain, the carboxy terminus of the B chain and at the side chain of an amino acid at any position of a linking moiety that links the A chain and B chain of a single chain insulin analog. In embodiment 3, embodiment 1 or 2 has the carboxy terminus of the glucagon related peptide covalently linked to the amino terminus of the B chain of the insulin peptide. In embodiment 4, the conjugate of any one of embodiments 1-3 comprises the insulin peptide as a single chain insulin analog. In embodiment 5 the conjugate of any of embodiments 1-4 comprises a single chain insulin analog wherein a glucagon related peptide is linked to the amino acid side chain of an amino acid of the linking moiety that links the A chain and B chain of the single chain insulin analog. In embodiment 6 the conjugate of any of embodiments 1-4 comprises a two chain insulin analog and said conjugate comprises a first and second glucagon related peptide wherein each glucagon related peptide is independently covalently linked to the insulin peptide at a position selected from the group consisting of the amino terminus of the B chain, the carboxy terminus of the A chain, and the carboxy terminus of the B chain.

In embodiment 7 the conjugate of any one of embodiment 1-6 is provided wherein the glucagon related peptide comprises (i) the amino acid sequence:
X1-X2-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Z (SEQ ID NO: 839) with 1 to 3 amino acid modifications thereto, wherein X1 and/or X2 is a non-native (relative to SEQ ID NO: 701) amino acid that reduces susceptibility of the glucagon related peptide to cleavage by dipeptidyl peptidase IV (DPP-IV), Z is selected from the group consisting of Asn-Thr-COOH, and Y—COOH, wherein Y is 1 to 2 amino acids, and further wherein (1) a lactam bridge connects the side chains of an amino acid at position i and an amino acid at position i+4, wherein i is 12, 16, 20 or 24 or (2) one, two, three, or all of the amino acids at positions 16, 20, 21, and 24 of the glucagon related peptide is substituted with an α, α-disubstituted amino acid;

and said glucagon related peptide has glucagon agonist activity;

(ii) the amino acid sequence of SEQ ID NO: 701 modified to comprise at least one amino acid modification selected from the group consisting of:
  substitution of Asn at position 28 with a charged amino acid;
  substitution of Asn at position 28 with a charged amino acid selected from the group consisting of Asp, Glu, cysteic acid, and homocysteic acid;
  substitution at position 28 with Asn, Asp, or Glu;
  substitution at position 28 with Glu;
  substitution of Thr at position 29 with a charged amino acid;
  substitution of Thr at position 29 with a charged amino acid selected from the group consisting of Lys, Arg, His, Asp, Glu, cysteic acid, and homocysteic acid;
  substitution at position 29 with Asp, Glu, or Lys;
  substitution at position 29 with Glu;
  insertion of 1-3 charged amino acids after position 29;
  insertion after position 29 of Glu or Lys;
  insertion after position 29 of Gly-Lys or Lys-Lys; or a combination thereof;
  and at least one amino acid modification selected from Group A or Group B, or a combination thereof;
  wherein Group A is an amino acid modification selected from the group consisting of substitution of Ser at position 16 with Thr or AIB; and
  wherein Group B is an amino acid modification selected from the group consisting of:
    substitution of His at position 1 with a non-native amino acid that reduces susceptibility of the glucagon related peptide to cleavage by dipeptidyl peptidase IV (DPP-IV),
    substitution of Ser at position 2 with a non-native amino acid that reduces susceptibility of the glucagon related peptide to cleavage by dipeptidyl peptidase IV (DPP-IV),
    substitution of Tyr at position 10 with Phe or Val;
    substitution of Lys at position 12 with Arg;
    substitution of Gln at position 20 with Ala or AIB;
    substitution of Asp at position 21 with Glu;
    substitution of Gln at position 24 with Ala or AIB;
    substitution of Met at position 27 with Leu or Nle;
    or a combination thereof;
  and wherein said glucagon related peptide has glucagon agonist activity;
(iii) a glucagon related peptide of SEQ ID NO: 701, modified to comprise
  (a) an amino acid modification at position 1 that confers GIP agonist activity,
  (b) (1) a lactam bridge between the side chains of amino acids at positions i and i+4 or between the side chains of amino acids at positions j and j+3, wherein i is 12, 13, 16, 17, 20 or 24, and wherein j is 17, or
    (2) one, two, three, or all of the amino acids at positions 16, 20, 21, and 24 of the analog is substituted with an α,α-disubstituted amino acid,
  (c) amino acid modifications at one, two or all of positions 27, 28 and 29, and
  (d) 1-6 further amino acid modifications,
  wherein the EC50 of the analog for GIP receptor activation is about 10 nM or less;
(iv) the sequence of SEQ ID NO: 72 or an analog of SEQ ID NO: 72, wherein said analog differs from SEQ ID NO: 72 by 1 to 3 amino acid modifications, selected from positions 1, 2, 3, 5, 7, 10, 11, 13, 14, 17, 18, 19, 21, 24, 27, 28, and 29, wherein said glucagon related peptide exhibits at least 20% of the activity of native GLP-1 at the GLP-1 receptor;

(v) an amino acid that differs from SEQ ID NO: 701 by no more than ten amino acid modifications, comprising one or more amino acid substitutions with AIB at positions 16, 20, 21, and/or 24, and an amino acid modification at position 1 and/or 2 that provides reduced susceptibility to cleavage by dipeptidyl peptidase IV, wherein said glucagon related peptide exhibits at least 20% of the activity of native GLP-1 at the GLP-1 receptor;

In embodiment 8 the conjugate of any one of embodiment 1-7 is provided wherein said insulin peptide comprises an A chain and a B chain wherein said A chain comprises a sequence GIVX$_4$X$_5$CCX$_8$X$_9$X$_{10}$CX$_{12}$LX$_{14}$X$_{15}$LX$_{17}$X$_{18}$YCX$_{21}$-R$_{13}$ (SEQ ID NO: 19), and said B chain comprises a sequence R$_{22}$-X$_{25}$LCGX$_{29}$X$_{30}$LVX$_{33}$X$_{34}$LYLVCGX$_{41}$X$_{42}$GFX$_{45}$ (SEQ ID NO: 20), wherein
  X$_4$ is glutamic acid or aspartic acid;
  X$_5$ is glutamine or glutamic acid
  X$_8$ is histidine, threonine or phenylalanine;
  X$_9$ is serine, arginine, lysine, ornithine or alanine;
  X$_{10}$ is isoleucine or serine;
  X$_{12}$ is serine or aspartic acid;
  X$_{14}$ is tyrosine, arginine, lysine, ornithine or alanine;
  X$_{15}$ is glutamine, glutamic acid, arginine, alanine, lysine, ornithine or leucine;
  X$_{17}$ is glutamic acid, aspartic acid, asparagine, lysine, ornithine or glutamine;
  X$_{18}$ is methionine, asparagine, glutamine, aspartic acid, glutamic acid or threonine;
  X$_{21}$ is selected from the group consisting of alanine, glycine, serine, valine, threonine, isoleucine, leucine, glutamine, glutamic acid, asparagine, aspartic acid, histidine, tryptophan, tyrosine, and methionine;
  X$_{25}$ is histidine or threonine;
  X$_{29}$ is selected from the group consisting of alanine, glycine and serine;
  X$_{30}$ is selected from the group consisting of histidine, aspartic acid, glutamic acid, homocysteic acid and cysteic acid;
  X$_{33}$ is selected from the group consisting of aspartic acid and glutamic acid;
  X$_{34}$ is selected from the group consisting of alanine and threonine;
  X$_{41}$ is selected from the group consisting of glutamic acid, aspartic acid or asparagine;
  X$_{42}$ is selected from the group consisting of alanine, ornithine, lysine and arginine;
  X$_{45}$ is tyrosine or phenylalanine;
  R$_{22}$ is selected from the group consisting of AYRPSE (SEQ ID NO: 14), FVNQ (SEQ ID NO: 12), PGPE (SEQ ID NO: 11), a tripeptide glycine-proline-glutamic acid, a tripeptide valine-asparagine-glutamine, a dipeptide proline-glutamic acid, a dipeptide asparagine-glutamine, glutamine, glutamic acid and an N-terminal amine; and
  R$_{13}$ is COOH or CONH$_2$.

In embodiment 9 the conjugate of any one of embodiments 1-7 is provided wherein said A chain comprises the sequence GIVEQCCX$_8$X$_9$ICSLYQLENYCX$_{21}$-R$_{13}$ (SEQ ID NO: 73) said B chain comprises the sequence R$_{22}$-X$_{25}$LCGX$_{29}$X$_{30}$LVX$_{33}$X$_{34}$LYLVCGX$_{41}$X$_{42}$GFX$_{45}$ (SEQ ID NO: 20)
  X$_8$ is histidine or threonine;
  X$_9$ is serine, lysine, or alanine;
  X$_{21}$ is alanine, glycine or asparagine;
  X$_{25}$ is histidine or threonine;
  X$_{29}$ is selected from the group consisting of alanine, glycine and serine;

$X_{30}$ is selected from the group consisting of histidine, aspartic acid, glutamic acid, homocysteic acid and cysteic acid;

$X_{33}$ is selected from the group consisting of aspartic acid and glutamic acid;

$X_{34}$ is selected from the group consisting of alanine and threonine;

$X_{41}$ is selected from the group consisting of glutamic acid, aspartic acid or asparagine;

$X_{42}$ is selected from the group consisting of alanine, ornithine, lysine and arginine;

$X_{45}$ is tyrosine or phenylalanine;

$R_{22}$ is selected from the group consisting of FVNQ (SEQ ID NO: 12), a tripeptide valine-asparagine-glutamine, a dipeptide asparagine-glutamine, glutamine and an N-terminal amine; and $R_{13}$ is COOH or $CONH_2$.

In embodiment 10 the conjugate of any one of embodiments 1-7 is provided wherein said A chain comprises a sequence GIVDECCX$_8$X$_9$SCDLRRLEMX$_{19}$CX$_{21}$-R$_{13}$ (SEQ ID NO: 74) and said B chain comprises a sequence R$_{22}$-X$_{25}$LCGAX$_{30}$LVDALYLVCGDX$_{42}$GFY (SEQ ID NO: 75), wherein $X_8$ is phenylalanine or histidine;

$X_9$ is arginine, ornithine or alanine;

$X_{19}$ is tyrosine, 4-methoxy-phenylalanine or 4-amino-phenylalanine;

$X_{21}$ is alanine or asparagine;

$X_{25}$ is histidine or threonine;

$X_{30}$ is selected from the group consisting of histidine, aspartic acid, glutamic acid, homocysteic acid and cysteic acid;

$X_{42}$ is selected from the group consisting of alanine ornithine and arginine; and $R_{13}$ is COOH or $CONH_2$;

$R_{22}$ is selected from the group consisting of AYRPSE (SEQ ID NO: 14), FVNQ (SEQ ID NO: 12), PGPE (SEQ ID NO: 11), a tripeptide glycine-proline-glutamic acid, a tripeptide valine-asparagine-glutamine, a dipeptide proline-glutamic acid, a dipeptide asparagine-glutamine, glutamine, glutamic acid and an N-terminal amine; and $R_{13}$ is COOH or $CONH_2$.

In embodiment 11 the conjugate of any one of embodiments 1-7 is provided wherein said B chain comprises a sequence $R_{22}$-$X_{25}$LCG$X_{29}X_{30}$LV$X_{33}X_{34}$LYLVCG$X_{41}$ $X_{42}$GF$X_{45}$YT-$Z_1$-$B_1$ (SEQ ID NO: 142), wherein $Z_1$ is a dipeptide selected from the group consisting of aspartate-lysine, lysine-proline, and proline-lysine; and $B_1$ is selected from the group consisting of threonine, alanine or a threonine-arginine-arginine tripeptide.

In embodiment 12 the conjugate of any one of embodiments 1-7 is provided wherein said A chain comprises a sequence GIVEQCCTSICSLYQLENYCN-$R_{13}$ (SEQ ID NO: 1) and said B chain comprises a sequence FVNQHLCGSHLVEALYLVCGERGFFYTPKT (SEQ ID NO: 2).

In embodiment 13 the conjugate of any one of embodiments 1-12 is provided wherein the insulin peptide is a single chain insulin and the peptide linker joining the B and A chains is selected from the group consisting of SSSSKAPPPSLPSPSRLPGPSDTPILPQR (SEQ ID NO: 52), SSSSRAPPPSLPSPSRLPGPSDTPILPQK (SEQ ID NO: 51), GAGSSS$X_{57}X_{58}$ (SEQ ID NO: 76), GYGSSS$X_{57}X_{58}$ (SEQ ID NO: 21) and GYGSSS$X_{57}X_{58}$APQT; (SEQ ID NO: 77), wherein $X_{57}$ and $X_{58}$ are independently arginine, lysine or ornithine.

In embodiment 14 the conjugate of any one of embodiments 1-13 is provided wherein the peptide linker is selected from the group consisting of GYGSSSRR (SEQ ID NO: 18) and GAGSSSRR (SEQ ID NO: 22).

In embodiment 15 the conjugate of any one of embodiments 1-14 is provided wherein the glucagon related peptide comprises the sequence of SEQ ID NO: 72 or an analog of SEQ ID NO: 72, wherein said analog differs from SEQ ID NO: 72 by 1 to 3 amino acid modifications, selected from positions 1, 2, 3, 5, 7, 10, 11, 13, 14, 17, 18, 19, 21, 24, 27, 28, and 29, wherein the glucagon related peptide comprises an intramolecular bridge between the side chains of the amino acids at positions 12 and 16, 16 and 20, 20 and 24, or 24 and 28 or a pharmaceutically acceptable salt thereof.

In embodiment 16 the conjugate of any one of embodiments 1-15 is provided wherein the glucagon related peptide comprises a salt bridge or a lactam bridge between amino acids at positions 16 and 20.

In embodiment 17 the conjugate of any one of embodiments 1-16 is provided further comprising a peptide selected from the group consisting of SEQ ID NOs: 78, 79, and 80 linked to the carboxy terminus of said glucagon related peptide. In embodiment 18 the conjugate of any one of embodiments 1-17 is provided wherein the amino acid at position 3 of the glucagon related peptide is glutamic acid. In embodiment 19 the conjugate of any one of embodiments 1-18 is provided wherein the amino acid at position 28 of the glucagon related peptide is Asp, Asn, or Lys, and the amino acid at position 29 of the glucagon related peptide is Gly or Thr. In embodiment 20 the conjugate of any one of embodiments 1-19 is provided wherein the amino acid at position 16 of the glucagon related peptide is glutamic acid, the amino acid at position 20 of the glucagon related peptide is lysine, and the C-terminal carboxylic acid group of the glucagon related peptide is replaced with an amide, optionally with a lactam bridge between the glutamic acid at position 16 and the lysine at position 20 of the glucagon related peptide. In embodiment 21 the conjugate of any one of embodiments 1-20 is provided wherein the amino acid at position 1 or 2 of the glucagon related peptide is modified to exhibit reduced susceptibility to cleavage by dipeptidyl peptidase IV (DPP-IV). In embodiment 22 the conjugate of any one of embodiments 1-21 is provided wherein the glucagon related peptide comprises an amino acid sequence selected from the group consisting of:

a. SEQ ID NO: 81;
b. SEQ ID NO: 83;
c. SEQ ID NO: 89;
d. any one of SEQ ID NOs: 84-88;
e. any one of SEQ ID Nos: 100-103;
f. SEQ ID NO: 108, wherein the amino acid at position 20 is selected from the group consisting of arginine, ornithine, and citrulline;
g. any one of SEQ ID Nos: 98, 99, 109-112, 104-106, and SEQ ID NO: 72, wherein the Xaa at position 28 of the peptide is asparagine or aspartic acid; the Xaa at position 29 of the peptide is threonine or glycine; and C-terminus of the peptide further comprises SEQ ID NO: 78, SEQ ID NO: 79, COOH or $CONH_2$; and
h. any one of SEQ ID Nos: 251, 319 and 510.

In embodiment 23 the conjugate of any one of embodiments 1-14 is provided wherein the glucagon related peptide comprises an analog of glucagon (SEQ ID NO: 701) having GIP agonist activity, said analog comprising one or more of the following modifications:

(a) an amino acid modification at position 1 that confers GIP agonist activity, optionally, wherein the amino acid at position 1 is an amino acid lacking an imidazole side chain;
(b) an amino acid substitution of Ser at position 16 with an amino acid of Formula IV:

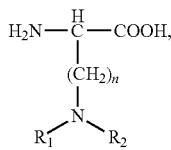

[Formula IV]

wherein n is 1 to 7, wherein each of R1 and R2 is independently selected from the group consisting of H, $C_1$-$C_{18}$ alkyl, ($C_1$-$C_{18}$ alkyl)OH, ($C_1$-$C_{18}$ alkyl)$NH_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl)($C_3$-$C_9$ heteroaryl), wherein $R_7$ is H or OH, and the side chain of the amino acid of Formula IV comprises a free amino group, the amino acid of Formula IV optionally being homoLys, Lys, Orn, or 2,4-diaminobutyric acid (Dab),
(c) one, two, three, or all of the amino acids at positions 16, 20, 21, and 24 of the analog is substituted with an α,α-disubstituted amino acid,
(d) amino acid modifications at one, two or all of positions 27, 28 and 29, and
(e) 1-9 further amino acid modifications relative to the glucagon sequence (SEQ ID NO: 701),
wherein the EC50 of the analog for GIP receptor activation is about 10 nM or less.

In embodiment 24 the conjugate of any one of embodiments 1-14 is provided wherein the glucagon related peptide comprises the following modifications: (a) the amino acid at position 1 is a large, aromatic amino acid, optionally, Tyr, and (b) wherein (i) the Met at position 27 is substituted with a large, aliphatic amino acid, optionally Leu, (ii) the Asn at position 28 is substituted with a small aliphatic amino acid, optionally Ala, or (iii) the Thr at position 29 is substituted with a small aliphatic amino acid, optionally Gly, or wherein the analog comprises a combination of (i), (ii), and (iii).

In embodiment 25 the conjugate of any one of embodiments 23 or 24 is provided wherein the glucagon related peptide further comprises the amino acid sequence of GPSSGAPPPS (SEQ ID NO: 95) or XGPSSGAPPPS (SEQ ID NO: 96) linked to said peptide at a position located C-terminal to the amino acid at position 29. In embodiment 26 the conjugate of any one of embodiments 1-14 and 23-25 is provided, wherein the glucagon related peptide further comprises one or more of the following modifications:
(a) Ser at position 2 substituted with D-Ser, Ala, D-Ala, Gly, N-methyl-Ser, AIB, Val, or α-amino-N-butyric acid;
(b) Gln at position 3 substituted with Glu;
(c) substitution of the amino acid Tyr at position 10 with an amino acid, optionally an amino acid of Formula I:

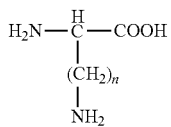

wherein n=1 to 4, comprising a side chain covalently linked to an acyl group or alkyl group;
(d) addition of an amino acid, optionally an amino acid of Formula I, comprising a side chain covalently linked to an acyl group or alkyl group as the C-terminal amino acid of the analog;
(e) Lys at position 12 substituted with Ile;
(f) Arg at position 17 substituted with Gln;
(g) Arg at position 18 substituted with Ala;
(h) Asp at position 21 substituted with Glu;
(i) Gln at position 24 substituted with Asn; and
(j) replacement of the carboxylic acid of the C-terminal amino acid with a charge-neutral group, optionally, an amide.

In embodiment 27 the conjugate of any one of embodiments 1-14 and 23-25 is provided wherein the glucagon related peptide comprises an amino acid sequence according to any one of SEQ ID NOS: 227, 228, 229 or 230 further comprising a terminal extension of an amino acid sequence of GPSSGAPPPS (SEQ ID NO: 820) or XGPSSGAPPPS (SEQ ID NO: 1096), wherein X is any amino acid, C-terminal to the amino acid at position 29. In embodiment 28 the conjugate of any one of embodiments 1-14 or 23 is provided wherein the glucagon related peptide comprises an amino acid sequence selected from the group consisting of SEQ ID NOs: 920-964, 146-164, 166, 192-207, 209-221 and 223. In embodiment 29 the conjugate of any one of embodiments 1-14 is provided wherein the glucagon related peptide comprises the sequence of SEQ ID NO: 701 or the a modified SEQ ID NO: 701 comprising one, two, three or more charged amino acid(s) at a position C-terminal to the amino acid at position 27 of the glucagon related peptide and up to 7 additional amino acid modifications of relative to SEQ ID NO: 701. In embodiment 30 the conjugate of any one of embodiments 1-14 or 29 is provided wherein one, two, three or more charged amino acid(s) at a position C-terminal to the amino acid at position 27 are provided wherein the charged amino acids are Glu or Asp. In embodiment 31 the conjugate of any one of embodiments 1-30 is provided wherein the glucagon related peptide comprises the sequence of HAEGTFTSDVSSYLEEQAAREFIAWLVR-GRG (SEQ ID NO: 700), HAEGTFTSDVSSYLE-GQAAKEFIAWLVKGRG (SEQ ID NO: 703), HAEGT-FTSDVSSYLEGQAAKEFICWLVKGR (SEQ ID NO: 717) HSQGTFTSDYSKYLDSRRAQDFVQWLMNT (SEQID NO: 701) or HSQGTFTSDYSKYLDERRAQDFVQ-WLMNT (SEQ ID NO: 699). In embodiment 29 the conjugate of any one of embodiments 1-31 is provided wherein the insulin peptide is a single chain insulin analog comprising the sequence GPEX$_{25}$LCGAX$_{30}$LVDAL- YLV- C-GDX$_{42}$GFYFNX$_{48}$X$_{49}$GAGSSSRRGIVDECCX$_8$RSCDLR RLENYCN-R$_{13}$ (SEQ ID NO: 144), FVNQHLCGSHL-VEALYLVCGERGFFYTPKTGAGSSSRRGIVEQCCTS-ICSLYQLENY CN-R$_{13}$ (SEQ ID NO: 143) or GPEHLC-GAHLVDALYLVCGDRGFYFNDRGAGSSSRRGIV-DECCHRSCDLRRLENYC N (SEQ ID NO: 145) wherein
X$_8$ is phenylalanine or histidine;
X$_{25}$ is histidine or threonine;
X$_{30}$ is histidine, aspartic acid, glutamic acid, homocysteic acid or cysteic acid;
X$_{42}$ is alanine ornithine or arginine;
X$_{48}$ is lysine or aspartic acid;
X$_{49}$ is proline, ornithine or arginine; and
R$_{13}$ is COOH or CONH$_2$.

In embodiment 33 the conjugate of any one of embodiments 1-32 is provided, wherein the conjugate is further modified to comprise the structure U-J, wherein
U is an amino acid or a hydroxy acid;
J is an N-alkylated amino acid linked to said conjugate through an amide bond between a carboxyl moiety of J and an amine of the conjugate, wherein U, J, or the amino acid of the conjugate to which U-J is linked is a non-coded amino acid, further wherein the chemical cleavage half-life ($t_{1/2}$) of U-J from the conjugate is at least about 1 hour to about 1 week in PBS under physiological conditions.

In embodiment 34 the conjugate of any one of embodiments 33 is provided wherein the conjugate further comprises a hydrophilic moiety covalently linked to structure U-J or alternatively a hydrophilic moiety is covalently linked to the side chain of an amino acid of said conjugate, including a hydrophilic moiety covalently linked at one or more positions corresponding to A14, A15, B0, B1, B10, B22, B28, B29 or positions 16, 17, 20, 21, 24, or 29 of native glucagon (SEQ ID NO: 701), or at the C-terminal region of the glucagon related peptide. Optionally in any of these embodiments, the hydrophilic moiety is a polyethylene glycol.

In embodiment 35 the conjugate of any one of embodiments 1-32 is provided, wherein the conjugate is further modified to comprise an acyl group or alkyl group covalently linked to an amino acid side chain. In a further embodiment, said acyl group or alkyl group is covalently linked to a position of the glucagon related peptide that corresponds to position 10 of native glucagon (SEQ ID NO: 701), or at one or more positions selected from A14, A15, B0, B1, B10, B22, B28, B29 of the insulin peptide, or at the side chain of an amino acid of the structure U-J. A pharmaceutical composition comprising a conjugate of any one of the preceding embodiments, or pharmaceutically acceptable salt thereof, and a pharmaceutically acceptable carrier is also provided in accordance with the present disclosure.

Example 1

Synthesis of Insulin A & B Chains

Insulin A & B chains were synthesized on 4-methylbenzhyryl amine (MBHA) resin or 4-Hydroxymethyl-phenylacetamidomethyl (PAM) resin using Boc chemistry. The peptides were cleaved from the resin using HF/p-cresol 95:5 for 1 hour at 0° C. Following HF removal and ether precipitation, peptides were dissolved into 50% aqueous acetic acid and lyophilized. Alternatively, peptides were synthesized using Fmoc chemistry. The peptides were cleaved from the resin using Trifluoroacetic acid (TFA)/Triisopropylsilane (TIS)/H$_2$O (95:2.5:2.5), for 2 hour at room temperature. The peptide was precipitated through the addition of an excessive amount of diethyl ether and the pellet solubilized in aqueous acidic buffer. The quality of peptides were monitored by RP-HPLC and confirmed by Mass Spectrometry (ESI or MALDI).

Insulin A chains were synthesized with a single free cysteine at amino acid 7 and all other cysteines protected as acetamidomethyl A-(SH)$^7$(Acm)$^{6,11,20}$. Insulin B chains were synthesized with a single free cysteine at position 7 and the other cysteine protected as acetamidomethyl B—(SH)$^7$(Acm)$^{19}$. The crude peptides were purified by conventional RP-HPLC.

The synthesized A and B chains were linked to one another through their native disulfide bond linkage in accordance with the general procedure outlined in FIG. 1. The respective B chain was activated to the Cys$^7$-Npys analog through dissolution in DMF or DMSO and reacted with 2,2'-Dithiobis (5-nitropyridine) (Npys) at a 1:1 molar ratio, at room temperature. The activation was monitored by RP-HPLC and the product was confirmed by ESI-MS.

Figure 2:
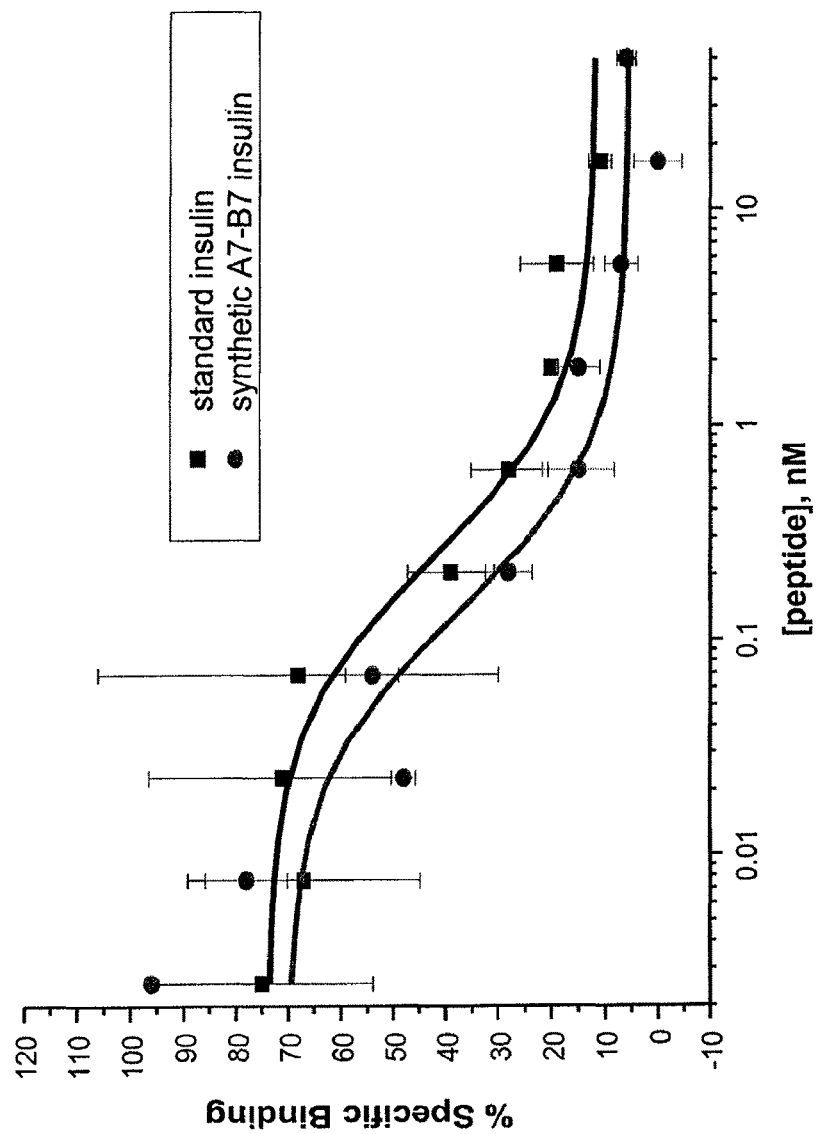
FIG. 2 is a graph comparing insulin receptor specific binding of synthetic human insulin relative to purified native insulin. The synthetic insulin was produced by the approach detailed in FIG. 1 where the $A^7$-$B^7$ bond is the first disulfide formed. As indicated by the data presented in the graph, the two molecules have similar binding activities.
Figure 3:
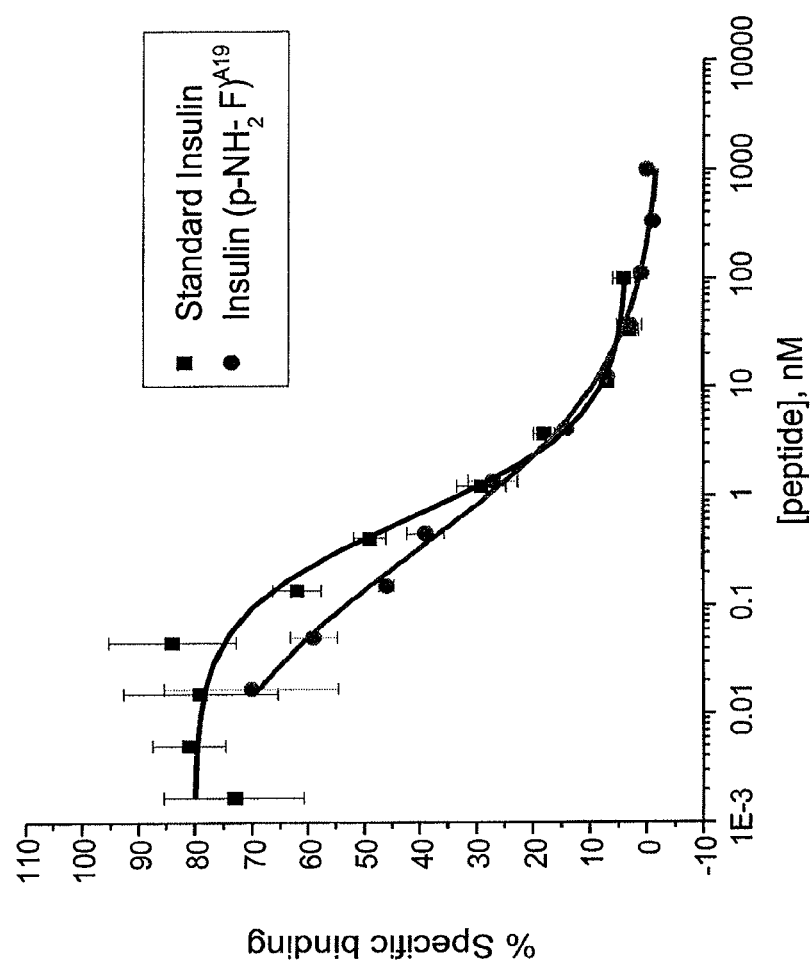
FIG. 3 is a graph comparing relative insulin receptor binding of native insulin and the A19 insulin analog (Insulin $(p-NH_2-F)^{19}$). As indicated by the data presented in the graph, the two molecules have similar binding activities.

The first B7-A7 disulfide bond was formed by dissolution of the respective A-(SH)$^7$(Acm)$^{6,11,20}$ and B-(Npys)$^7$(Acm)$^{19}$ at 1:1 molar ratio to a total peptide concentration of 10 mg/ml. When the chain combination reaction was complete the mixture was diluted to a concentration of 50% aqueous acetic acid. The last two disulfide bonds were formed simultaneously through the addition of iodine. A 40 fold molar excess of iodine was added to the solution and the mixture was stirred at room temperature for an additional hour. The reaction was terminated by the addition of an aqueous ascorbic acid solution. The mixture was purified by RP-HPLC and the final compound was confirmed by MALDI-MS. As shown in FIG. 2 and the data in Table 1, the synthetic insulin prepared in accordance with this procedure compares well with purified insulin for insulin receptor binding.

Insulin peptides comprising a modified amino acid (such as 4-amino phenylalanine at position A19) can also be synthesized in vivo using a system that allows for incorporation of non-coded amino acids into proteins, including for example, the system taught in U.S. Pat. Nos. 7,045,337 and 7,083,970.

TABLE 1

Activity of synthesized insulin relative to native insulin

|  | Insulin Standard | | A7-B7 Insulin | |
| --- | --- | --- | --- | --- |
|  | AVER. | STDEV | AVER. | STDEV |
| IC$_{50}$(nM) | 0.24 | 0.07 | 0.13 | 0.08 |
| % of Insulin Activity | 100 | | 176.9 | |

Example 2

Pegylation of Amine Groups (N-Terminus and Lysine) by Reductive Alkylation a. Synthesis Insulin (or an insulin analog), mPEG20k-Aldyhyde, and NaBH$_3$CN, in a molar ratio of 1:2:30, were dissolved in acetic acid buffer at a pH of 4.1-4.4. The reaction solution was composed of 0.1N NaCl, 0.2N acetic acid and 0.1N Na$_2$CO$_3$. The insulin peptide concentration was approximately 0.5 mg/ml. The reaction occurs over six hours at room temperature. The degree of reaction was monitored by RP-HPLC and the yield of the reaction was approximately 50%.

b. Purification

The reaction mixture was diluted 2-5 fold with 0.1% TFA and applied to a preparative RP-HPLC column. HPLC condition: C4 column; flow rate 10 ml/min; A buffer 10% ACN and 0.1% TFA in water; B buffer 0.1% TFA in ACN; A linear gradient B % from 0-40% (0-80 min); PEG-insulin or analogues was eluted at approximately 35% buffer B. The desired compounds were verified by MALDI-TOF, following chemical modification through sulftolysis or trypsin degradation.

Pegylation of Amine Groups (N-Terminus and Lysine) by N-Hydroxysuccinimide Acylation.

a. Synthesis

Insulin (or an insulin analog) along with mPEG20k-NHS were dissolved in 0.1N Bicine buffer (pH 8.0) at a molar ratio of 1:1. The insulin peptide concentration was approximately 0.5 mg/ml. Reaction progress was monitored by HPLC. The yield of the reaction is approximately 90% after 2 hours at room temperature.

b. Purification

The reaction mixture was diluted 2-5 fold and loaded to RP-HPLC. HPLC condition: C4 column; flow rate 10 ml/min; A buffer 10% ACN and 0.1% TFA in water; B buffer 0.1% TFA in ACN; A linear gradient B % from 0-40% (0-80 min); PEG-insulin or analogues was collected at approximately 35% B. The desired compounds were verified by MALDI-TOF, following chemical modification through sulftolysis or trypsin degradation.

Reductive Aminated Pegylation of Acetyl Group on the Aromatic Ring of the Phenylalanine a. Synthesis Insulin (or an insulin analogue), mPEG20k-Hydrazide, and $NaBH_3CN$ in a molar ratio of 1:2:20 were dissolved in acetic acid buffer (pH of 4.1 to 4.4). The reaction solution was composed of 0.1N NaCl, 0.2N acetic acid and 0.1N $Na_2CO_3$. Insulin or insulin analogue concentration was approximately 0.5 mg/ml. at room temperature for 24 h. The reaction process was monitored by HPLC. The conversion of the reaction was approximately 50%. (calculated by HPLC)

b. Purification

The reaction mixture was diluted 2-5 fold and loaded to RP-HPLC. HPLC condition: C4 column; flow rate 10 ml/min; A buffer 10% ACN and 0.1% TFA in water; B buffer 0.1% TFA in ACN; A linear gradient B % from 0-40% (0-80 min); PEG-insulin, or the PEG-insulin analogue was collected at approximately 35% B. The desired compounds were verified by MALDI-TOF, following chemical modification through sulftolysis or trypsin degradation.

Example 3

Insulin Receptor Binding Assay:

The affinity of each peptide for the insulin or IGF-1 receptor was measured in a competition binding assay utilizing scintillation proximity technology. Serial 3-fold dilutions of the peptides were made in Tris-Cl buffer (0.05M Tris-HCl, pH 7.5, 0.15M NaCl, 0.1% w/v bovine serum albumin) and mixed in 96 well plates (Corning Inc., Acton, Mass.) with 0.05 nM (3-[125I]-iodotyrosyl) A TyrA14 insulin or (3-[125I]-iodotyrosyl) IGF-1 (Amersham Biosciences, Piscataway, N.J.). An aliquot of 1-6 micrograms of plasma membrane fragments prepared from cells over-expressing the human insulin or IGF-1 receptors were present in each well and 0.25 mg/well polyethylene imine-treated wheat germ agglutinin type A scintillation proximity assay beads (Amersham Biosciences, Piscataway, N.J.) were added. After five minutes of shaking at 800 rpm the plate was incubated for 12 h at room temperature and radioactivity was measured with MicroBeta1450 liquid scintillation counter (Perkin-Elmer, Wellesley, Mass.). Non-specifically bound (NSB) radioactivity was measured in the wells with a four-fold concentration excess of "cold" native ligand than the highest concentration in test samples. Total bound radioactivity was detected in the wells with no competitor. Percent specific binding was calculated as following: % Specific Binding=(Bound-NSB/Total bound-NSB)×100. IC50 values were determined by using Origin software (OriginLab, Northampton, Mass.).

Example 4

Insulin Receptor Phosphorylation Assay:

To measure receptor phosphorylation of insulin or incretin-insulin conjugate, receptor transfected HEK293 cells were plated in 96 well tissue culture plates (Costar #3596, Cambridge, Mass.) and cultured in Dulbecco's modified Eagle medium (DMEM) supplemented with 100 IU/ml penicillin, 100 μg/ml streptomycin, 10 mM HEPES and 0.25% bovine growth serum (HyClone SH30541, Logan, Utah) for 16-20 hrs at 37° C., 5% $CO_2$ and 90% humidity. Serial dilutions of insulin or insulin analogs were prepared in DMEM supplemented with 0.5% bovine serum albumin (Roche Applied Science #100350, Indianapolis, Ind.) and added to the wells with adhered cells. After 15 min incubation at 37° C. in humidified atmosphere with 5% $CO_2$ the cells were fixed with 5% paraformaldehyde for 20 min at room temperature, washed twice with phosphate buffered saline pH 7.4 and blocked with 2% bovine serum albumin in PBS for 1 hr. The plate was then washed three times and filled with horseradish peroxidase-conjugated antibody against phosphotyrosine (Upstate biotechnology #16-105, Temecula, Calif.) reconstituted in PBS with 2% bovine serum albumin per manufacturer's recommendation. After 3 hrs incubation at room temperature the plate was washed 4 times and 0.1 ml of TMB single solution substrate (Invitrogen, #00-2023, Carlbad, Calif.) was added to each well. Color development was stopped 5 min later by adding 0.05 ml 1N HCl. Absorbance at 450 nm was measured on Titertek Multiscan MCC340 (ThermoFisher, Pittsburgh, Pa.). Absorbance vs. peptide concentration dose response curves were plotted and $EC_{50}$ values were determined by using Origin software (OriginLab, Northampton, Mass.).

Glucagon and GLP-1 Functional Assay-cAMP Synthesis

The ability of individual incretin or incretin-insulin analogs to induce cAMP was measured in a firefly luciferase-based reporter assay. HEK293 cells co-transfected with a receptor (glucagon receptor, GLP-1 receptor or GIP receptor) and luciferase gene linked to cAMP responsive element were serum deprived by culturing 16 h in DMEM (Invitrogen, Carlsbad, Calif.) supplemented with 0.25% Bovine Growth Serum (HyClone, Logan, Utah) and then incubated with serial dilutions of either glucagon, GLP-1, GIP or novel glucagon analogs for 5 h at 37° C., 5% $CO_2$ in 96 well poly-D-Lysine-coated "Biocoat" plates (BD Biosciences, San Jose, Calif.). At the end of the incubation 100 microliters of LucLite luminescence substrate reagent (Perkin-Elmer, Wellesley, Mass.) were added to each well. The plate was shaken briefly, incubated 10 min in the dark and light output was measured on MicroBeta-1450 liquid scintillation counter (Perkin-Elmer, Wellesley, Mass.). Effective 50% concentrations were calculated by using Origin software (OriginLab, Northampton, Mass.

Example 5

Figure 4:
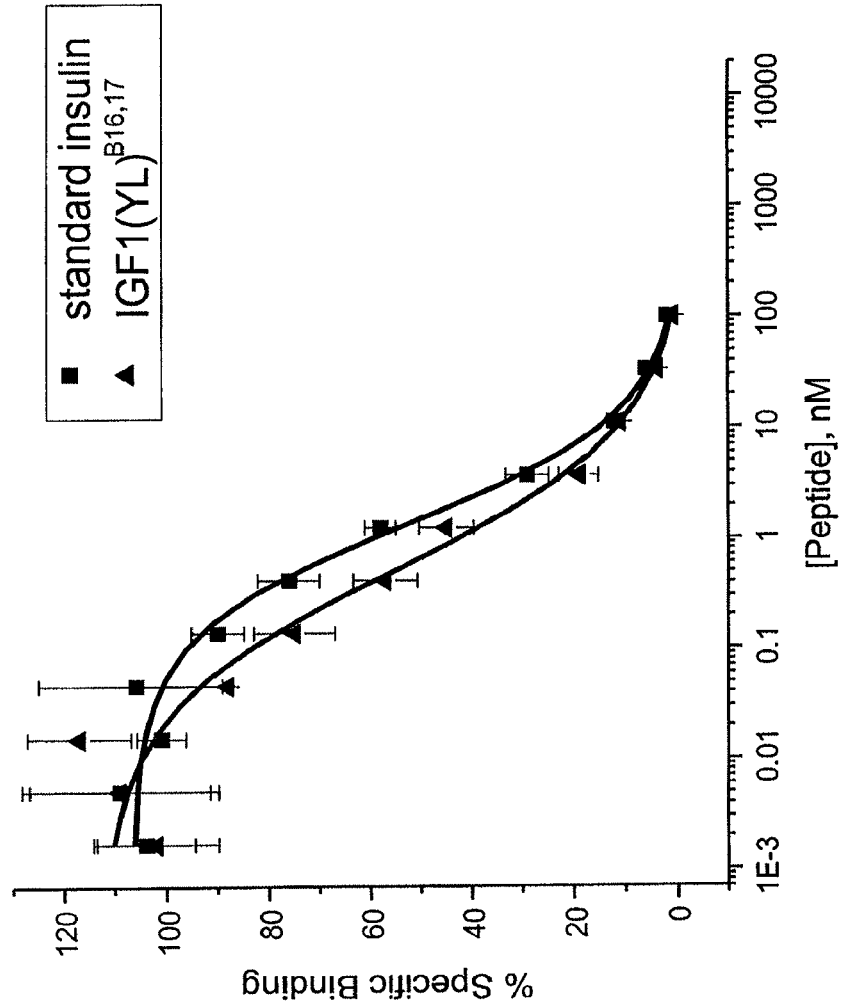
FIG. 4 is a graph comparing relative insulin receptor binding of native insulin and the $IGF1(Y^{B16}L^{B17})$ analog. As indicated by the data presented in the graph, the two molecules have similar binding activities.

Insulin like Growth Factor (IGF) Analog IGF1 ($Y^{B16}L^{B17}$) Applicants have discovered an IGF analog that demonstrates similar activity at the insulin receptor as native insulin. More particularly, the IGF analog (IGF1 ($Y^{B16}L^{B17}$) comprises the native IGF A chain (SEQ ID NO: 5) and the modified B chain (SEQ ID NO: 6), wherein the native glutamine and phenylalanine at positions 15 and 16 of the native IGF B-chain (SEQ ID NO: 3) have been replaced with tyrosine and leucine residues, respectively. As shown in FIG. 4 and Table 2 below the binding activities of IGF1 ($Y^{B16}L^{B17}$) and native insulin demonstrate that each are highly potent agonists of the insulin receptor.

TABLE 2

|  | Insulin Standard | | IGF1 ($Y^{B16}L^{B17}$) | |
| --- | --- | --- | --- | --- |
|  | AVER. | STDEV | AVER. | STDEV |
| $IC_{50}$(nM) | 1.32 | 0.19 | 0.51 | 0.18 |
| % of Insulin Activity | 100 | | 262 | |

Example 6

Additional IGF Insulin Analogs.

Further modifications of the IGF1 ($Y^{B16}L^{B17}$) peptide sequence reveal additional IGF insulin analogs that vary in their potency at the insulin and IGF-1 receptor. Binding data is presented in Table 3 for each of these analogs (using the assay of Example 3), wherein the position of the modification is designated based on the corresponding position in the native insulin peptide (DPI=des B26-30). For example, a reference herein to "position B28" absent any further elaboration would mean the corresponding position B27 of the B chain of an insulin analog in which the first amino acid of SEQ ID NO: 2 has been deleted. Thus a generic reference to "B(Y16)" refers to a substitution of a tyrosine residue at position 15 of the B chain of the native IGF-1 sequence (SEQ ID NO: 3). Data regarding the relative receptor binding of insulin and IGF analogs is provided in Table 3, and data regarding IGF analog stimulated phosphorylation (using the assay of Example 4) is provided in Table 4.

TABLE 3

Receptor Binding Affinity of Insulin and IGF Analogues

| | Insulin Receptor | | | | | IGF-1 Receptor | | | | | |
|---|---|---|---|---|---|---|---|---|---|---|---|
| Analogue | nM IC$_{50}$: | STDev | Date | % insulin (in test) | % native insulin activity (0.6 nM) | IC$_{50}$: | STDev | Date | % IGF-1 (in test) | % native IGF-1 activity (0.55 nM) | Ratio |
| IGF-1 A:B | 10.41 | 1.65 | Sep. 4, 2007 | 5.8 | 5.8 | | | | | | |
| IGF-1 A:B(E10Y16L17) | 0.66 | 0.36 | May 22, 2007 | 58.7 | 90.9 | 7.85 | 1.98 | Jun. 4, 2007 | 6.8 | 7.0 | 11.9 |
| | 0.51 | 0.18 | May 29, 2007 | 98.8 | 117.6 | 12.19 | 2.17 | Sep. 18, 2007 | 5.0 | 4.5 | |
| IGF-1 A:B(E10 Y16L17)-E31E3 2B-COOH | 1.22 | 0.30 | Mar. 20, 2008 | 36.5 | 50.0 | 17.50 | 2.25 | Apr. 4, 2007 | 3.0 | 3.1 | 14.3 |
| IGF-1 A:B(D10Y16L17) DPI A-COOH | 0.26 | 0.02 | Nov. 9, 2007 | 301.0 | 231.0 | 6.79 | 1.50 | Apr. 4, 2008 | 7.7 | 8.1 | |
| | 0.2 | 0.02 | Dec. 4, 2007 | 380.1 | 300.0 | | | | | | |
| | 0.42 | 0.06 | Jun. 5, 2008 | 174.1 | 144.1 | | | | | | |
| IGF-1 A:B (E10Y16L17) DPI | 0.38 | 0.08 | Aug. 10, 2007 | 51.1 | 157.9 | 22.89 | 5.26 | Sep. 18, 2007 | 3.3 | 2.4 | 60.2 |
| IGF-1 A:B (H5D10Y16L17) DPI | 0.16 | 0.07 | Nov. 9, 2007 | 479.0 | | 4.66 | 0.77 | Apr. 4, 2008 | 11.2 | 11.8 | 29.1 |
| IGF-1 A:B (H5D10Y16L17) (S=O)DPI | 0.25 | 0.04 | Nov. 9, 2007 | 316.0 | | | | | | | |
| IGF-1 A (H8 A9 N21): B(H5D10Y16L17) DPI A-COOH | 0.05 | 0.01 | Dec. 4, 2007 | 1576.7 | | 4.03 | 0.50 | Apr. 4, 2008 | 12.9 | 13.6 | 80.6 |
| | 0.09 | 0.02 | Dec. 14, 2007 | 1667.0 | | | | | | | |
| IGF-1 A (H8 A9 N21): B(H5D10Y16L17 A22) DPI A-COOH | 0.12 | 0.02 | Dec. 14, 2007 | 1171.4 | | 22.83 | 3.53 | Apr. 4, 2008 | 2.3 | 2.4 | 190.3 |
| IGF-1 A (H8 A9 N21): B(H5D10Y16L17 A22) (S=O) DPI A-COOH | 0.36 | 0.10 | Dec. 14, 2007 | 400.7 | | | | | | | |
| IGF-1 A: IGF-1 B(1-8)-In (9-17)-IGF-1 B(18-30) | 1.59 | 0.62 | May 22, 2007 | 19.1 | 37.7 | 131.30 | 58.05 | Jun. 4, 2007 | 0.3 | 0.4 | 82.6 |
| IGF-1 A: In (1-17)-IGF-1 B (18-30) | 2.77 | 1.19 | May 22, 2007 | 14.0 | 21.7 | 62.50 | 30.28 | Jun. 4, 2007 | 0.9 | 0.9 | 22.6 |
| | 2.67 | 0.67 | May 18, 2007 | 11.3 | 22.5 | | | | | | |
| | 2.48 | 1.35 | May 29, 2007 | 20.1 | 24.2 | | | | | | |
| IGF-1 A: In B(1-5)-IGF-1 B(YL)(6-30) | 0.31 | 0.19 | Aug. 10, 2007 | 62.4 | 193.5 | 27.54 | 6.57 | Sep. 25, 2007 | 3.6 | 2 | 88.8 |
| IGF-2 native | | | | | | 13.33 | 1.85 | Sep. 25, 2007 | 7.5 | 4.5 | |
| IGF-2 AB | | | | | | | | | | | |
| IGF-2 AB(YL) | 6.81 | 3.81 | Oct. 10, 2007 | 8.4 | 8.8 | | | | | | |
| In A: IGF-1 B(YL) | 82.62 | 31.75 | Sep. 4, 2007 | 0.9 | 0.7 | | | | | | |
| | 107.24 | 65.38 | Sep. 4, 2007 | 0.7 | 0.6 | | | | | | |
| In A- IGF-2 D: In B- IGF-2 C | 0.53 | 0.11 | Sep. 4, 2007 | 141.0 | 113.0 | 1.59 | 0.34 | Sep. 18, 2007 | 47.6 | 34.6 | |
| | 0.37 | 0.05 | Oct. 13, 2007 | 179.1 | 162.2 | 14.69 | 3.02 | Sep. 25, 2007 | 6.8 | 3.7 | 39.5 |

**All C terminals are amides (DPI) unless specified otherwise

TABLE 4

Total Phosphorylation by IGF-1 & IGF-2 Analogues

| Analogue | Insulin Receptor | | | | IGF-1 Receptor | | | | Selective |
|---|---|---|---|---|---|---|---|---|---|
| | EC50: | STDev | Date | % Insulin | EC50: | STDev | Date | % IGF | Ratio |
| Insulin | 1.26 | 0.098 | Dec. 14, 2007 | | 114.88 | 46.66 | Jan. 23, 2008 | | 90.89 |
| | 1.43 | 0.72 | Apr. 1, 2008 | | 86.02 | 29.35 | May 20, 2008 | | |
| | 1.12 | 0.11 | Mar. 31, 2008 | | | | | | |
| | 1.53 | 0.13 | Apr. 11, 2008 | | | | | | |
| | 2.70 | 0.71 | Apr. 16, 2008 | | | | | | |
| | 1.22 | 0.40 | May 20, 2008 | | | | | | |
| IGF-1 | 54.39 | 21.102 | Dec. 14, 2007 | 2.3 | 0.87 | 0.16 | Jan. 23, 2008 | 100 | 0.02 |
| | | | | | 0.49 | 0.13 | May 20, 2008 | | |
| | | | | | 0.97 | 0.48 | Jul. 23, 2008 | | |
| IGF-1 AB | | | | | | | | | |
| IGF-1 A: B(E10Y16L17) | 2.57 | 0.59 | Mar. 31, 2008 | 49.2 | 7.42 | 5.59 | Jul. 23, 2008 | 13 | |
| IGF-1 A:B(E10 Y16L17)-E31E32 B-COOH | 7.00 | 2.82 | Mar. 31, 2008 | 18.1 | | | | | |
| | 8.52 | 4.34 | Apr. 16, 2008 | 31.7 | | | | | |
| IGF-1 AB(D10Y16L17) DPI A-COOH | 0.08 | 0.006 | Dec. 14, 2007 | 1575 | 0.78 | 0.17 | Jan. 23, 2008 | 111.538 | 9.75 |
| | 4.38 | 2.98 | Apr. 16, 2008 | ?? | | | | | |
| IGF-1 AB (E10Y16L17) DPI | | | | | | | | | |
| IGF-1 AB (H5D10Y16L17) DPI | | | | | 12.22 | 5.46 | Jan. 23, 2008 | 7.1 | |
| IGF-1 AB (H5D10Y16L17) (S=O)DPI | | | | | | | | | |
| IGF-1 A (H8 A9 N21) B(H5D10Y16L17) DPI A-COOH | 0.15 | 0.054 | Dec. 14, 2007 | 840 | 0.43 | 0.44 | Jan. 23, 2008 | 181.395 | 2.81 |
| | 0.25 | 0.2 | Apr. 16, 2008 | 1080 | | | | | |
| IGF-1 A (H8 A9 N21) B(H5D10Y16L17A22) DPI A-COOH | 0.35 | 0.064 | Dec. 14, 2007 | 360 | 11.26 | 2.55 | Jan. 23, 2008 | 7.7 | 32.54 |
| | 0.44 | 0.17 | Apr. 16, 2008 | 614 | | | | | |
| IGF-1 A (H8 A9 N21) B(H5D10Y16L17A22) (S=O) DPI A-COOH | 0.72 | 0.098 | Dec. 14, 2007 | | | | | | |

*All C-terminals are amides unless specified otherwise.

Example 7

Biosynthesis and Purification of Single Chain Insulin Analogs

An insulin-IGF-I minigene comprising a native insulin B and A chain linked via the IGF-I C chain ($B^0$-$C^1$-$A^0$) was cloned into expression vector pGAPZα A (purchased from Invitrogen) under GAP promoter (promoter of the glyceraldehyde-3-phosphate dehydrogenase (GAPDH)) for constitutive expression and purification of recombinant protein in yeast Pichia pastoris. The minigene was fused to an N-terminal peptide encoding Saccharomyces cerevisiae α-mating factor leader signal for secretion of the recombinant protein into the medium. A Kex2 cleavage site between the minigene and the leading α-mating factor sequence was used to cleave the leader sequence for secretion of the minigene with native amino termini. Single-site alanine mutations were introduced into C peptide at positions 1 (G1A), 2 (Y2A), 3 (G3A), 4 (S4A), 5 (S5A), 6 (S6A), 7 (R7A), 8 (R8A), 10 (P10A), 11 (Q11A), and 12 (T12A) of the $B^0C^1A^0$ minigene.

The minigenes including $B^0C^1A^0$, eleven alanine mutants, and other select derivatives were transformed into yeast Pichia pastoris by electroporation. Positive transformants were selected on minimal methanol plates and a genomic preparation of each Pichia isolate was performed and integration of the constructs into the yeast genome was confirmed by PCR. An 833 base pair PCR product was visualized on an agarose DNA gel. The insulin analogs were produced by fermentation of a corresponding yeast line. The yeast cells were pelleted by centrifugation at 5 K for 20 minutes in 500 ml Beckman centrifuge tubes and the media was kept for subsequent protein purification.

Growth media supernatants were filtered through 0.2 m Millipore filter. Acetonitrile (ACN) was added to the supernatant to a final volume of 20%. The supernatant was purified over a Amberlite XAD7HP resin from Sigma, pre-equilibrated with 20% aqueous ACN. The resin was then rinsed twice with 30 ml of 20% aqueous ACN and contaminants were removed with 30% aqueous ACN containing 0.1% TFA. Partially purified insulin analogs were eluted from the column with 54% aqueous ACN containing 0.1% TFA and lyophilizied. Lyophilized samples were re-suspended in 0.025M $NH_3HCO_3$ pH 8 and purified on a Luna C18 column (10 m particle size, 300 A° pore size). Protein was eluted from the column using a linear gradient of 20-60% aqueous ACN. MALDI-MS positive fractions were pooled and transferred to a disposable scintillation vial for subsequent lyophilization. Lyophilized samples were then resuspended in 20% aqueous ACN containing 0.1% TFA, and purified on a Luna C18 column (10 m particle size, 300 A° pore size). The protein was eluted from the column using a linear gradient of 18-54% aqueous ACN with 0.1% TFA. Protein elution was monitored at an absorbance 280 nm. MALDI-TOF MS positive fractions were analyzed via a C8 analytical column to insure purity.

The $B^0$-$C^1$-$A^0$ analog demonstrated potency that was equally effective at both insulin receptor isoforms and the IGF-1 receptor. Mutation of the tyrosine at position 2 to alanine or the shortening of the C-peptide to eight amino acids through deletion of $C_{9-12}$ provided a selective enhancement in the specificity of insulin action by significant reduction in the IGF-1 receptor activity. See also the data provided in Tables 5A and 5B:

TABLE 5A

Insulin Binding & Phosphorylation Analysis
($B^0C^1A^0$)

| Peptide | Insulin Binding IC$_{50}$, nM | n | Insulin Phosphorylation EC$_{50}$, nM | n |
|---|---|---|---|---|
| Insulin | 0.54 ± 0.02 | 4 | 1.67 ± 0.13 | 1 |
| IGF-1 | 18.81 ± 1.77 | 3 | 29.20 ± 8.41 | 1 |
| 010 ($B^0C^1A^0$) | 2.83 ± 0.52 | 2 | 1.93 ± 0.43 | 1 |
| G1A | 1.21 ± 0.15 | 1 | 2.4 ± 0.24 | 1 |
| Y2A | 1.95 ± 0.28 | 3 | 1.86 ± 0.42 | 1 |
| G3A | 1.41 ± 0.05 | 2 | 2.13 ± 0.02 | 1 |
| S4A | 0.84 ± 0.47 | 2 | 0.76 ± 0.35 | 1 |
| S5A | 0.93 ± 0.44 | 1 | 2.23 ± 1.27 | 1 |
| S6A | 1.15 ± 0.24 | 1 | 2.33 ± 1.65 | 2 |
| R7A | 6.04 ± 0.82 | 1 | 5.21 ± 4.14 | 1 |
| R8A | 0.63 ± 0.09 | 1 | 2.03 ± 0.06 | 2 |
| P10A | 2.86 ± 0.93 | 1 | 2.59 ± 1.2 | 1 |
| Q11A | 1.79 ± 0.47 | 1 | 2.58 ± 0.83 | 1 |
| T12A | 1.2 ± 0.18 | 1 | 2.83 ± 1.31 | 1 |

TABLE 5B

IGF-1 Binding & Phosphorylation Analysis
($B^0C^1A^0$)

| Peptide | IGF-1 Binding IC$_{50}$, nM | n | IGF-1 Phosphorylation EC$_{50}$, nM | n |
|---|---|---|---|---|
| Insulin | 60.63 ± 4.43 | 1 | 48.66 ± 1.59 | 1 |
| IGF-1 | 0.38 ± 0.07 | 1 | 0.88 ± 0.41 | 1 |
| 010 ($B^0C^1A^0$) | 4.49 ± 1.04 | 1 | 1.29 ± 2.28 | 1 |
| G1A | 42.36 ± 16.24 | 1 | 1.4 ± 0.62 | 1 |
| Y2A | 257.9 ± 29.59 | 1 | 35.6 ± 14.55 | 1 |
| G3A | 34.02 ± 16.09 | 1 | 7.85 ± 0.78 | 1 |
| S4A | 15.30 ± 3.10 | 1 | 1.64 ± 1.65 | 1 |
| S5A | 13.06 ± 3.01 | 1 | 2.63 ± 1.88 | 1 |
| S6A | 2.44 ± 0.79 | 1 | 1.54 ± 0.62 | 2 |
| R7 | 43.86 ± 8.72 | 1 | 1.26 ± 1.55 | 1 |
| R8 | 10.85 ± 1.47 | 1 | 0.50 ± 0.23 | 2 |
| P10A | 6.42 ± 0.47 | 1 | 2.79 ± 1.12 | 1 |
| Q11A | 4.23 ± 0.43 | 1 | 0.41 ± 0.69 | 1 |
| T12A | 9.15 ± 0.83 | 1 | 1.44 ± 1.36 | 1 |

Position 2 and 3 in the C-peptide are most sensitive to modification at the IGF-1 receptor with the insulin receptor proving to be relatively immune to modification. All of the analogs maintained single unit nanomolar activity with certain specific analogs proving to be slightly enhanced in potency (low single unit nanomolar). The most insulin selective analogs were those that we missing the last four residues of the C-peptide, had an alanine mutation at position two of the C-peptide, or a combination of the two changes.

Example 8

Construction of Expression Vectors for Incretin-Insulin Hybrids.

The genes of each of the incretin-insulin hybrids were synthesize by PCR, and then ligated into the expression vector modified from pET30a which includes a Small Ubiquitin-like modifier (SUMO) as a fusion leader sequence. There is a Tobacco Etch Virus (TEV) protease cleavage site positioned between SUMO and incretin-insulin hybrid. An In-Fusion HD Cloning System (Clontech) was used for ligation.

The expression and purification of incretin-insulin hybrids was conducted as follows. The expression vectors were transformed into Origami B (DE3) (Novagen) competent cells. The cells were cultured in Luria Broth (LB) with 50 ug/ml Ampicillin, 25 ug/ml kanamycin and 5 ug/ml tetracycline at 37° C. until DO600 nm reached 0.8-1.0. At that point the temperature was changed to 18° C. and IPTG was added (0.2 mM) to the culture to induce gene expression. The induction was continued overnight, and then cells were harvested by centrifugation at 5,000 rpm for 15 minutes.

The fermentation cell pellet were suspended in 25 mM Tris, pH8.0, that included 300 mM NaCl, 10 mM Imidazole, 6M Guanidine Hydrochloride and the cells were lysed by sonication. The lysate was centrifuged at 15,000 rpm for 30 minutes and the supernatant was loaded to a Ni-NTA affinity column. The column was washed with 25 mM Tris, pH8.0, that included 300 mM NaCl, 20 mM Imidazole. The protein was eluted with the same buffer of 25 mM Tris, pH8.0, with 300 mM NaCl that also included 500 mM imidazole. The purified protein was digested with TEV protease overnight at 4° C. and diluted fourfold v/v with MiliQ water. This protein solution was applied to a Q-Sepharose column pre equilibrated with 20 mM Tris, pH8.0 with 10% glycerol. The Q-Sepharose column was eluted with a gradient of 100-600 mM NaCl, over fifteen column volumes. The purity of the chromatographically purified proteins was confirmed by analytical HPLC and MALDI-TOF mass spectrum.

Example 9

In Vitro Activity of Incretin-Insulin Fusions

A series of incretin-insulin fusion polypeptides were constructed to measure the activity of the compounds at the insulin and respective incretin receptors using the in vitro assays disclosed in Example 4. FIG. 6 presents the sequence of a set of GLP1 and GIP fusion peptides formed with a single chain insulin analog. Additional incretin-insulin derivatives were formed wherein the sequence of the insulin component or the incretin component of the conjugate is modified to eliminate the activity of one of the two components of the conjugate.

More particularly, the GLP-1 Parent Peptide (GLP1-DP8; SEQ ID NO: 132) was formed between a GLP-1 peptide that has agonist activity at the GLP-1 receptor and an insulin peptide (DP8) that has agonist activity at the insulin receptor. Derivatives of GLP1-DP8 were prepared wherein the insulin sequence is modified by substituting the tyrosine at position A19 with alanine to effectively eliminate insulin activity (GLP1-DP8A19; SEQ ID NO: 133), or the GLP sequence was modified by substituting the phenylalanine at position 22 with alanine to effectively eliminate GLP-1 activity (GLP1-A22; SEQ ID NO: 134). Similarly, a glucagon Parent Peptide (Glu-DP8; SEQ ID NO: 135) was formed between a glucagon peptide that has agonist activity at the glucagon receptor and an insulin peptide that has agonist activity at the insulin receptor. Derivatives of Glu-DP8 were prepared wherein the insulin sequence is modified by substituting the tyrosine at position A19 with alanine to effectively eliminate insulin activity (Glu-DP8A19; SEQ ID NO: 136), or the glucagon sequence was modified by substituting the glutamine at position 3 with glutamic acid to eliminate glucagon activity. Additional, a further derivative of Glu-DP8 was designed to have activity at the insulin, glucagon and GLP-1 receptors wherein the Glu-DP8 sequences was modified by the substitution of the serine at position 16 with glutamic acid (Glucagon E16 (SEQ ID NO: 138).

Each of the conjugates was synthesized as disclosed in Example 8 and chromatographically purified. FIGS. 7 and 8 presents the $EC_{50}$ values of chromatographically isolated pool fractions of the synthesized GLP1-DP8 and Glu-DP8 conjugates, respectively, at the insulin, GLP1 and glucagon receptors, relative to native insulin, IGF-1 and native glucagon. For the isolated GLP1-DP8 conjugate fractions, pool 1 demonstrates almost identical activity as native insulin at the insulin receptor (see FIG. 7). All three pools demonstrated high activity at the GLP1 receptor. Accordingly, the conjugate of pool 1 demonstrates potency as high as native insulin and native GLP1 at their two respective receptors. For the isolated Glu-DP8 conjugate fractions, pool 1 demonstrates similar activity as native insulin at the insulin receptor, with the presence of the glucagon sequence moderating the activity of the conjugate at the insulin receptor. Pools 1 and 3 demonstrated high activity at the glucagon receptor. All three pool demonstrate poor activity at the GLP-1 receptor. Accordingly, the conjugate of pool 1 demonstrates high potency at the insulin and glucagon, but retaining selectivity with regard to the GLP1 receptor. Accordingly, the purified conjugates demonstrate the expected activities at their respective receptors indicating that the conjugates retain the activity of both of the two original active peptides that were joined.

Figure 9A:
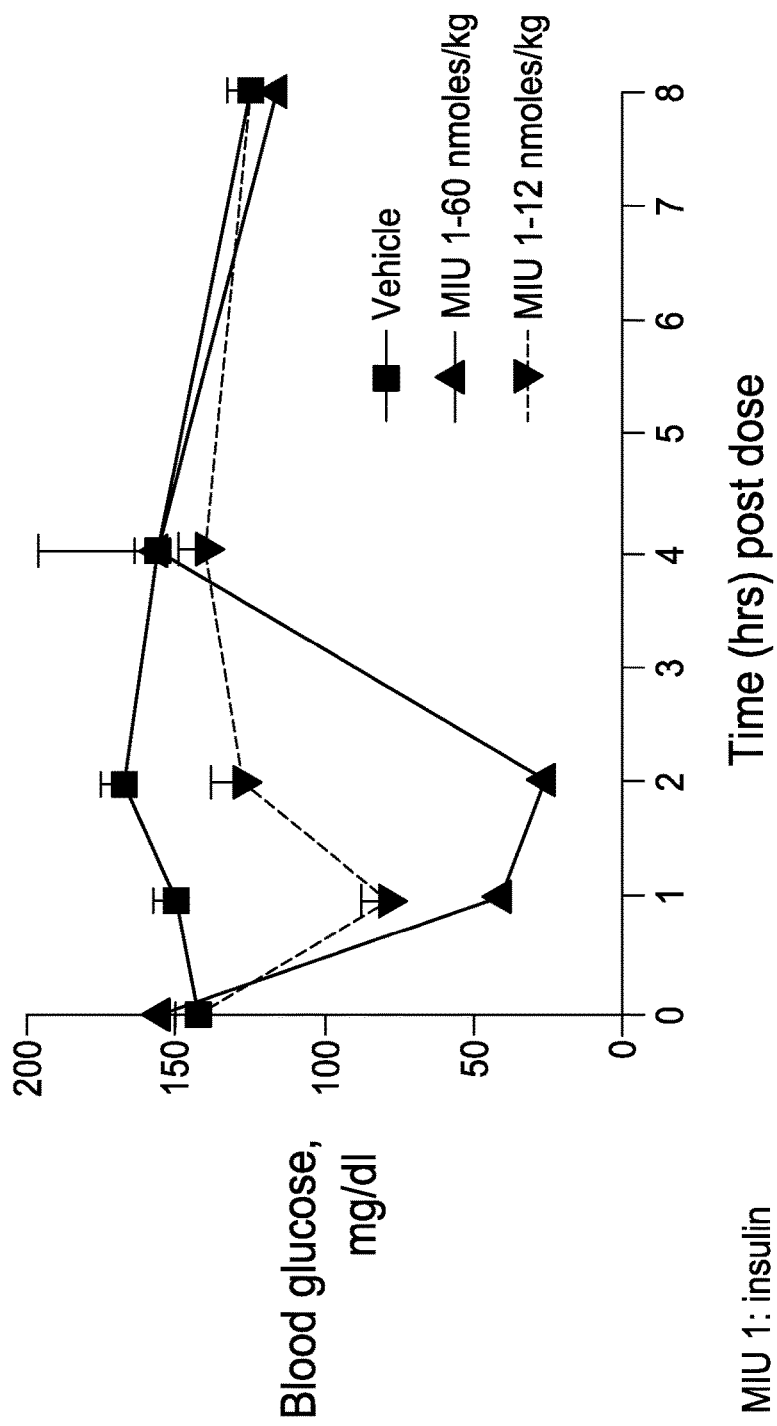
FIGS. 9A-9C demonstrate the in vivo effect of native insulin and the Glu-DP8 and GLP1-DP8 conjugates on blood glucose levels. Mice were subcutaneously injected with either native insulin (FIG. 9A) at two doses (12 nmol/kg or 60 nmol/kg), or one of the conjugates, GLP1-DP8 (FIG. 9B) or Glu-DP8 (FIG. 9C) administered at three different concentrations (12 nmol/kg, 60 nmol/kg and 300 nmol/kg). The conjugates demonstrated a less steep drop in blood glucose and a longer half life than native insulin (greater duration of action). In addition GLP1-DP8 (FIG. 9B) is more active in glucose lowering than Glu-DP8 (FIG. 9C), this is believed to result from glucagon buffering against insulin activity.
Figure 9B:
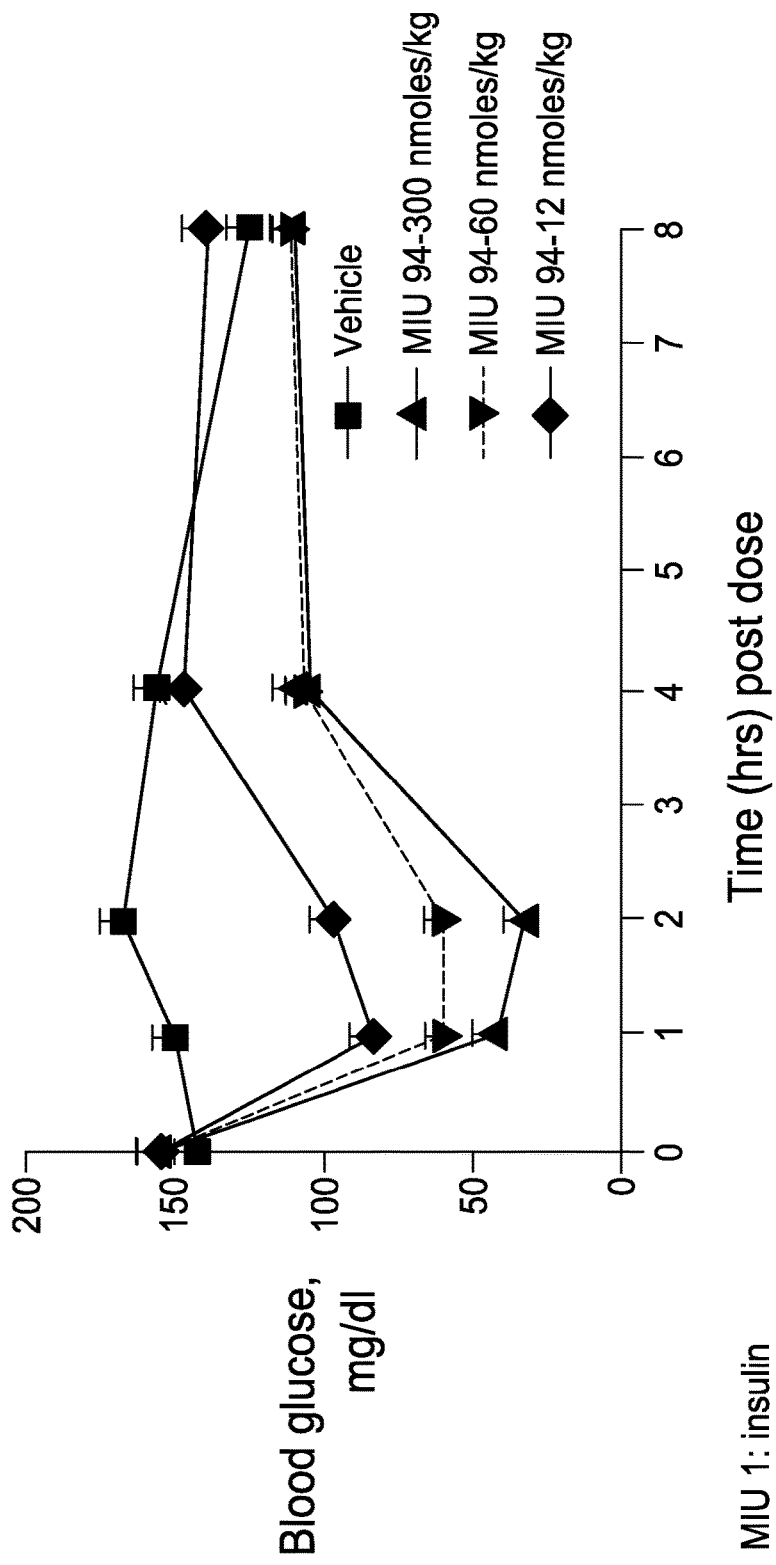
Figure 9C:
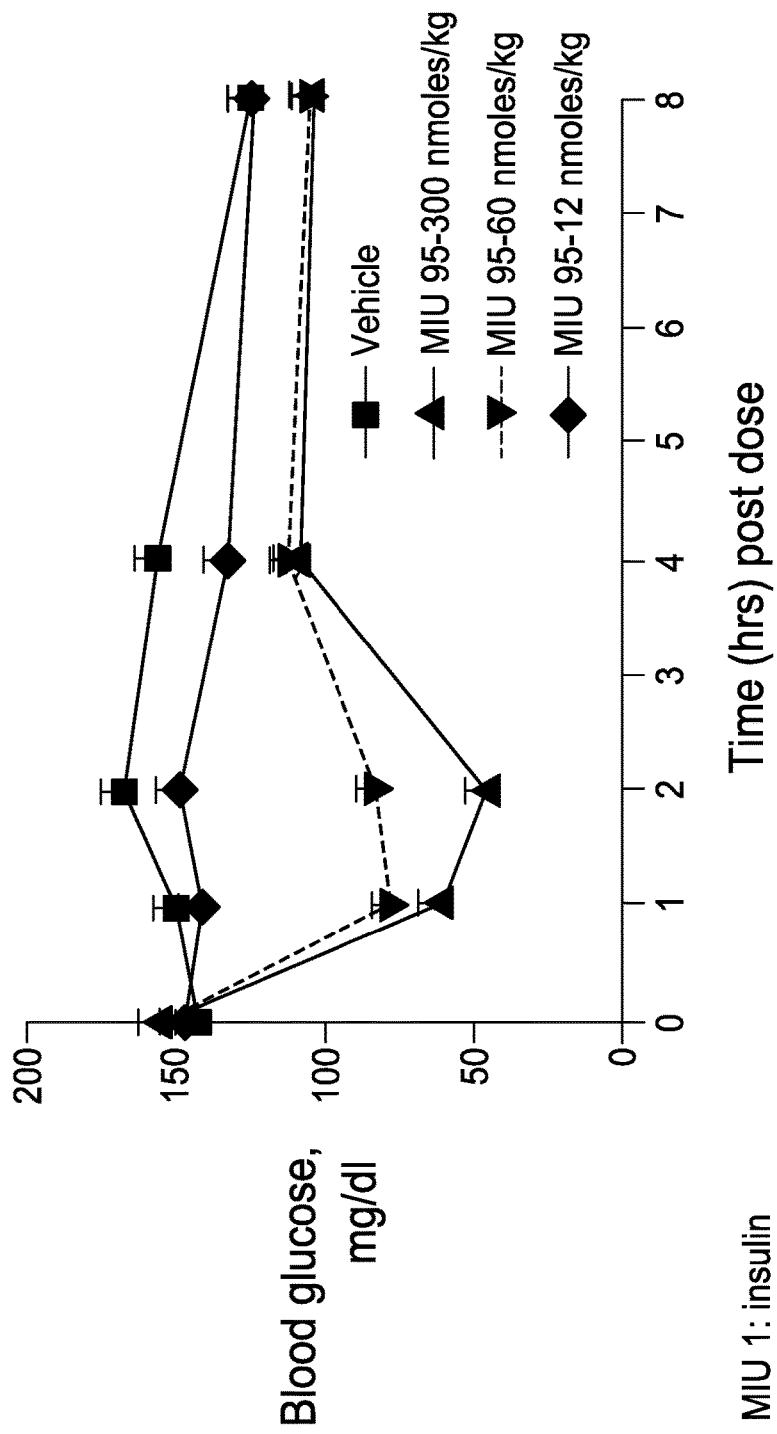

The ability of the Glu-DP8 and GLP1-DP8 conjugates to lower blood glucose levels was investigated by administering the compounds to C57BL/6 Mice and measuring blood glucose. Mice were subcutaneously injected with either native insulin (FIG. 9A) at two doses (12 nmol/kg or 60 nmol/kg), or one of the conjugates, GLP1-DP8 (FIG. 9B) or Glu-DP8 (FIG. 9C) administered at three different concentrations (12 nmol/kg, 60 nmol/kg and 300 nmol/kg). The conjugates demonstrated a less steep drop in blood glucose and a longer half life than native insulin (greater duration of action). In addition GLP1-DP8 (FIG. 9B) is more active in glucose lowering than Glu-DP8 (FIG. 9C). This is believed to result from glucagon buffering against insulin activity. Accordingly, the conjugates show the ability to lower blood glucose in vivo and have a profile different from that of native insulin.

The activity of the Glu-DP8 and GLP1-DP8 conjugates can be modified using known mutation to knock out one of the two (incretin or insulin) activities of the conjugates. Each of the modified Glu-DP8 and GLP1-DP8 conjugates (GLP1-DP8A19, GLP1-A22, Glu-DP8A19, Glucagon E3 and Glucagon E16) was tested at the insulin, glucagon and GLP-1 receptors and the activities of the conjugates matched the expected activities for each compound. FIG. 10 provides the in vitro activity of GLP1-DP8 and GLP1-DP8A19. Substitution of alanine at the A19 position effectively eliminates insulin's activity at the insulin receptor. $EC_{50}$ values indicate that both insulin and GLP1-DP8 are potent insulin receptor agonists, whereas GLP-1 and GLP1-DP8A19 have poor activity at the insulin receptor.

FIG. 11 presents the in vitro insulin receptor activity ($EC_{50}$ values) of Glu-DP8 and derivative conjugates. In summary, each of the compounds demonstrates activity at the glucagon and insulin receptors and that activity can be disrupted by modifying the insulin or glucagon sequence. Each of the conjugates shows activity consistent with its peptide sequence and the conjugates do not cross react. Specifically, $EC_{50}$ values indicate that both insulin and Glu-DP8 are potent insulin receptor agonists, whereas glucagon and Glu-DP8A19 have poor activity at the insulin receptor. GluE3-DP8 and GluE16-DP8 also showed high potency at the insulin receptor due to the presence of the DP8 insulin sequence.

FIG. 12 presents the in vitro glucagon receptor activity ($EC_{50}$ values) of Glu-DP8, GluE3-DP8 and GluE16-DP8, Glu-DP8A19, and GLP-1-DP8. The glutamic acid substitution at position 3 of glucagon is known to effectively eliminate glucagon activity, and substitution of alanine at the A19 position of insulin is known to effectively eliminate insulin activity at the insulin receptor. The glutamic acid substitution at position 16 of glucagon produces a co-agonist of glucagon and GLP-1. The $EC_{50}$ values indicate that glucagon, Glu-DP8 and GluE16-DP8 are potent glucagon receptor agonists, whereas GLP-1 and GLP1-DP8, and GluE3-DP8 have poor activity at the glucagon receptor. Accordingly, the conjugates exhibit the expected activities.

FIG. 13 presents the in vitro GLP-1 receptor activity ($EC_{50}$ values) of GLP-1, GLP-1-DP8, GLP-1A22-DP8, GLP-1-DP8A19, Glu-DP8, and GluE16-DP8. GLP-1A22-DP8 represents a conjugate of insulin and GLP-1 wherein position 22 has been substituted with alanine, a modification known to effectively eliminate GLP-1 activity. $EC_{50}$ values indicate that GLP-1, GLP1-DP8 and GLP1-DP8A19 are potent GLP-1 receptor agonists, whereas GLP-1A22-DP8, Glu-DP8, and GluE16-DP8 have less activity at the GLP-1 receptor. Accordingly, the conjugates exhibit the expected activities.

Figure 14B:
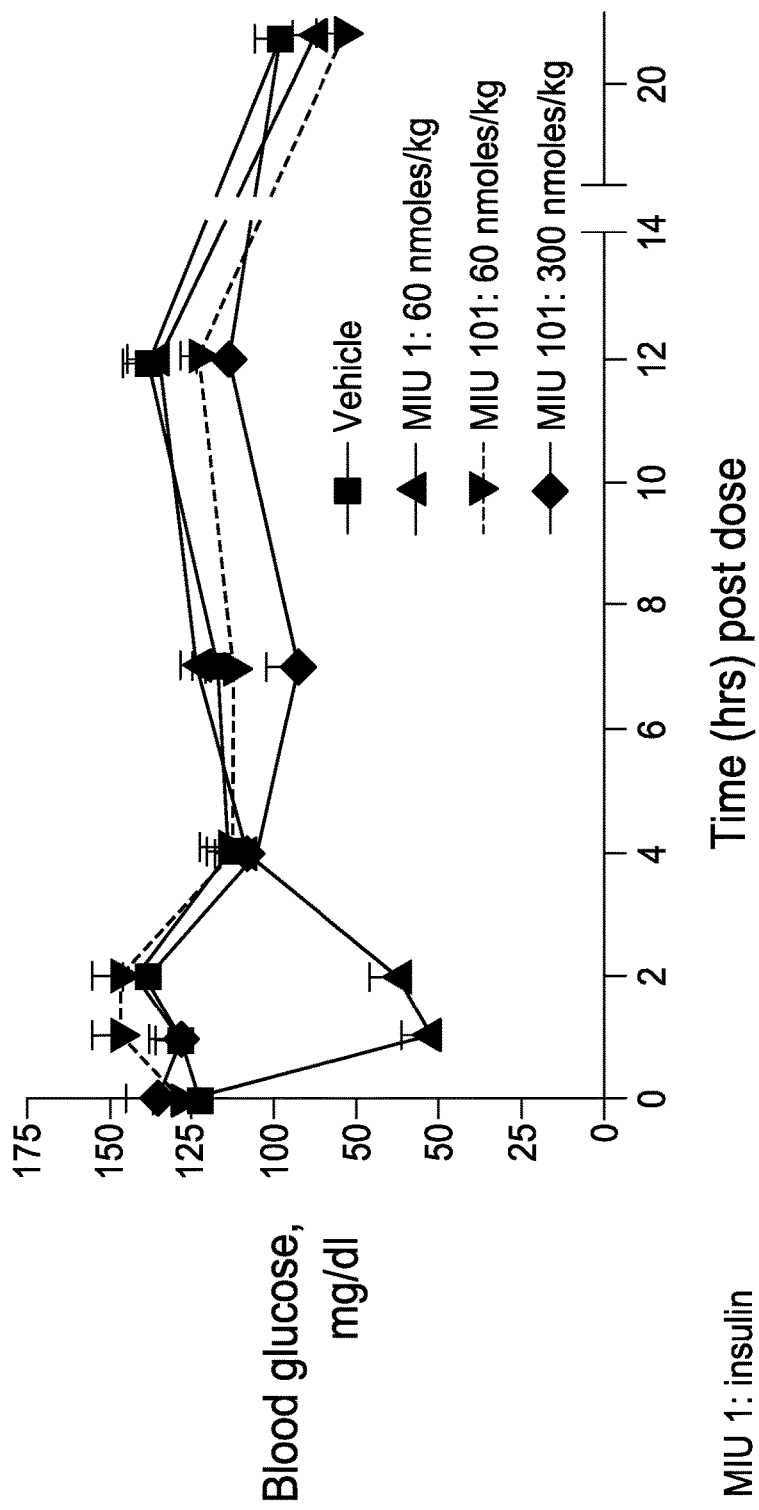
Figure 15A:
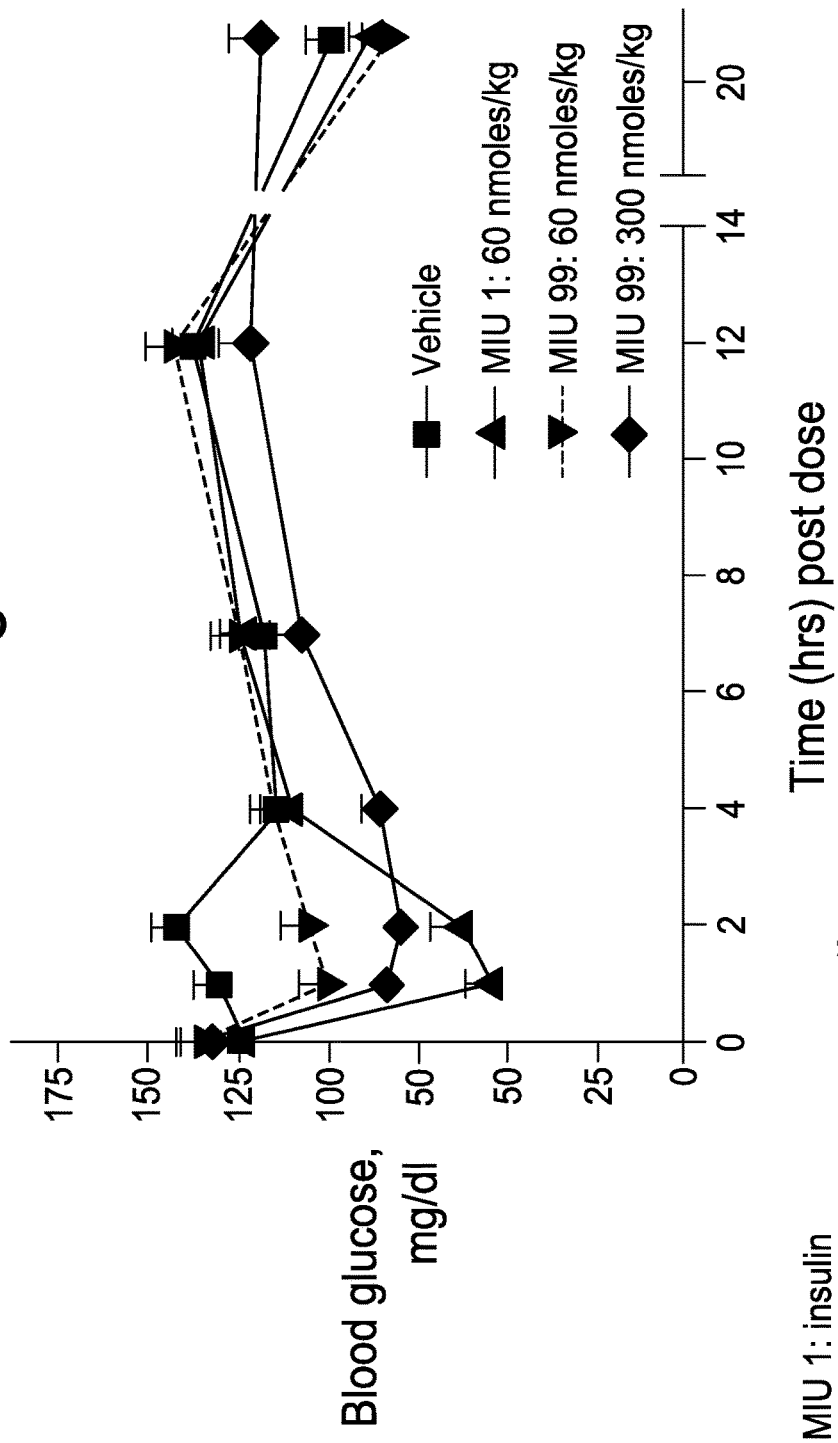
FIG. 15A-15C present the in vivo effect of the listed conjugates on blood glucose levels in C57BL/6 mice administered Glu-DP8A19 (FIG. 15A) or GLP1A22-DP8 (FIG. 15B) or GluE3/DP8 (FIG. 15C), relative to native insulin. The Glu-DP8A19 conjugate lacks insulin activity, yet still induces blood glucose lowering in vivo resulting from glucagon stimulated insulin secretion. GLP1A22-DP8 has reduced glucagon activity as a result of the substitution at position 22, however the insulin component of the conjugate provides blood glucose reducing activity such that the conjugate has approximately one fifth the activity of insulin. GluE3/DP8 has reduced glucagon activity due to the substitution at position E3, however the conjugate has glucose lowering activity that is slightly blunted relative to native insulin.
Figure 15B:
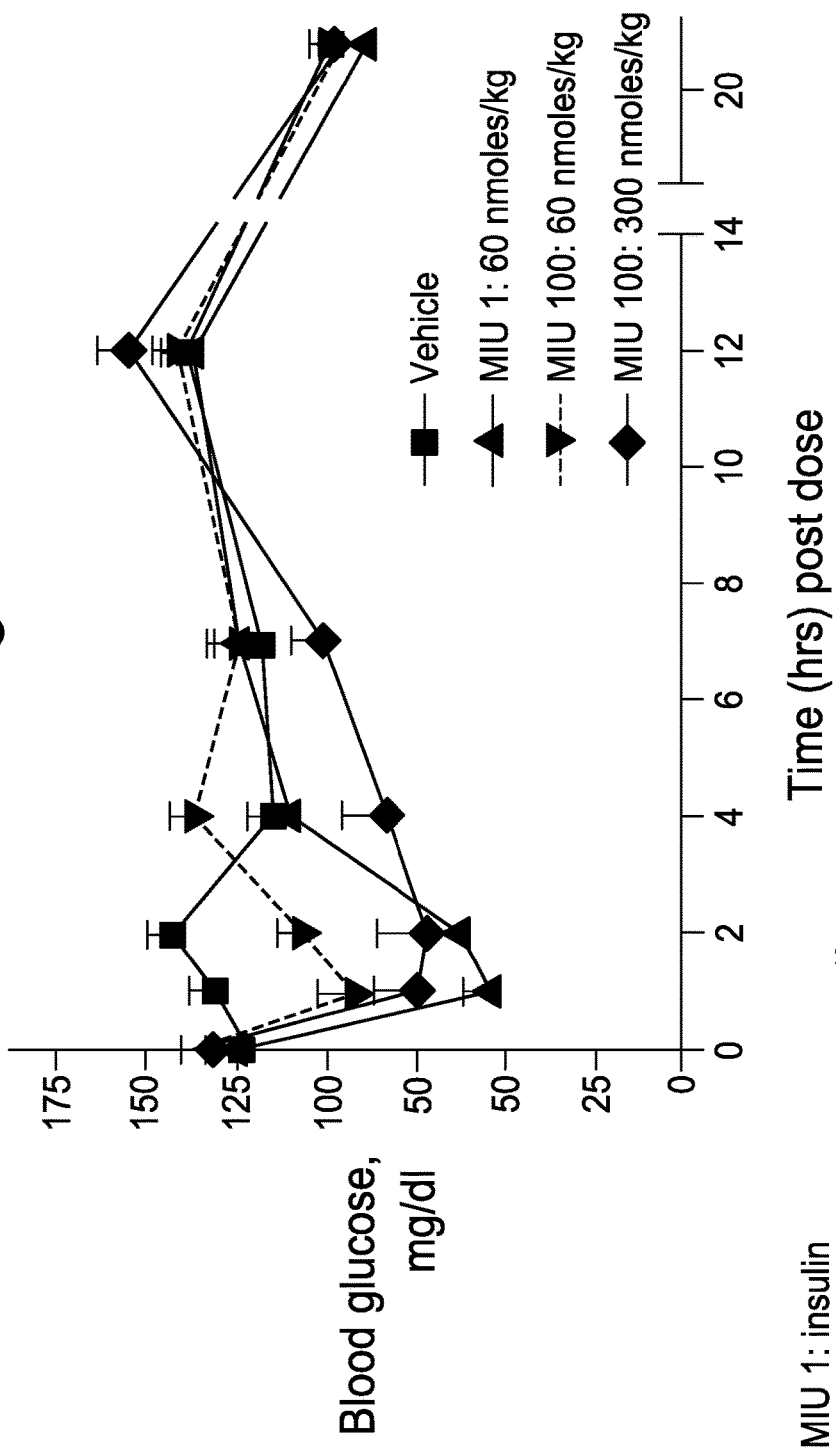
Figure 15C:
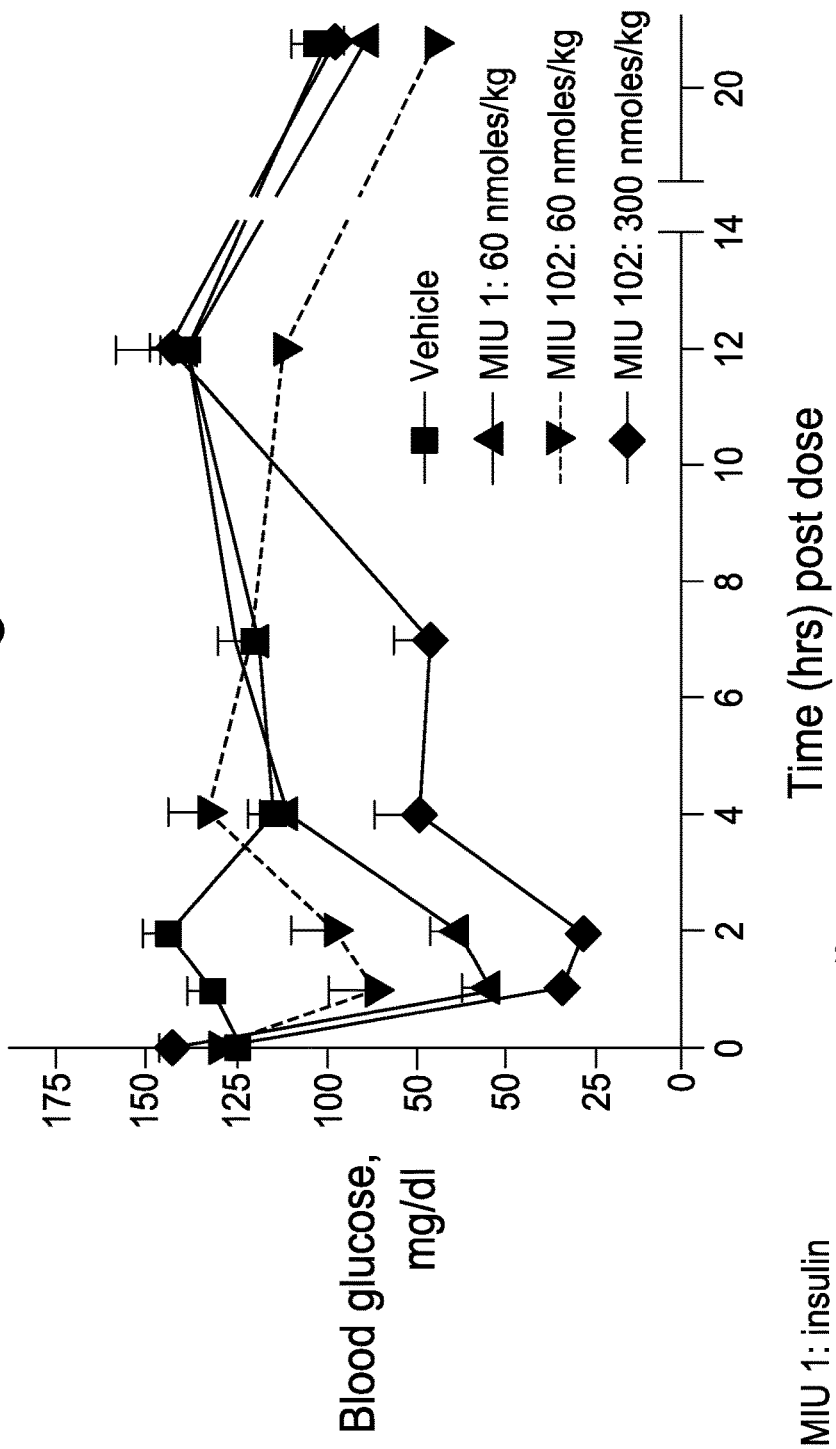

The GLP1-DP8 and Glu-DP8 conjugates and their derivatives were tested in vivo for their ability to lower blood glucose levels. The in vivo results were consistent with the in vitro receptor data. FIGS. 14A-14B present the in vivo effect of the listed conjugates on blood glucose levels in C57BL/6 mice administered DP8 (FIG. 14A) or GLP1-DP8A19 (FIG. 14B) relative to native insulin. DP8 successfully lowered blood glucose whereas GLP1-DP8A19 failed to significantly lower blood glucose levels. FIG. 15A-15C present the in vivo effect of the listed conjugates on blood glucose levels in C57BL/6 mice administered Glu-DP8A19 (FIG. 15A) or GLP1A22-DP8 (FIG. 15B) or GluE3/DP8 (FIG. 15C), relative to native insulin. The Glu-DP8A19 conjugate lacks insulin activity, yet still induces blood glucose lowering in vivo resulting from glucagon stimulated insulin secretion. GLP1A22-DP8 has reduced glucagon activity as a result of the substitution at position 22, however the insulin component of the conjugate provides blood glucose reducing activity such that the conjugate has approximately one fifth the activity of insulin. GluE3/DP8 has reduced glucagon activity due to the substitution at position E3, however the conjugate has glucose lowering activity that is slightly blunted relative to native insulin.

SEQUENCE LISTING (1922 sequences)

SEQ ID NO: 1 - protein, 21 aa, Homo sapiens
GIVEQCCTSICSLYQLENYCN

SEQ ID NO: 2 - protein, 30 aa, Homo sapiens
FVNQHLCGSHLVEALYLVCGERGFFYTPKT

SEQ ID NO: 3 - protein, 70 aa, Homo sapiens
GPETLCGAELVDALQFVCGDRGFYFNKPTGYGSSSRRAPQTGIVDECCFRSCDLRRLEMYCAPLKPAKSA

SEQ ID NO: 4 - protein, 67 aa, Homo sapiens
AYRPSETLCGGELVDTLQFVCGDRGFYFSRPASRVSRRSRGIVEECCFRSCDLALLETYCATPAKSE

SEQ ID NO: 5 - protein, 21 aa, Homo sapiens
GIVDECCFRSCDLRRLEMYCA

SEQ ID NO: 6 - protein, 30 aa, Homo sapiens
FGPETLCGAELVDALYLVCGDRGFYFNKPT

SEQ ID NO: 7 - protein, 21 aa, Homo sapiens
GIVEECCFRSCDLALLETYCA

SEQ ID NO: 8 - protein, 32 aa, Homo sapiens
AYRPSETLCGGELVDTLQFVCGDRGFYFSRPA

SEQ ID NO: 9 - protein, 8 aa, Artificial Sequence
  spacer sequence
  MISC_FEATURE (1)..(1): The Xaa at position 1 represents an amino acid selected from glycine, alanine, valine, leucine, isoleucine, proline, phenylalanine and methionine
  MISC_FEATURE (2)..(2): The Xaa at position 2 represents any amino acid other than tyrosine
  MISC_FEATURE (3)..(6): The Xaas at positions 3-6 are independently any amino acid
  MISC_FEATURE (7)..(8): The Xaas at positions 7 and 8 are independently selected from arginine, lysine or ornithine
XXXXXXXX

SEQ ID NO: 10 - protein, 8 aa, Artificial Sequence
  spacer sequence
  MISC_FEATURE (1)..(1): The Xaa at position 1 represents an amino acid selected from glycine, alanine, valine, leucine, isoleucine, proline, phenylalanine and methionine
  MISC_FEATURE (2)..(2): The Xaa at position 2 represents any amino acid other than tyrosine
  MISC_FEATURE (3)..(6): The Xaas at positions 3-6 are independently any amino acid
XXXXXXRR

SEQ ID NO: 11 - protein, 4 aa, Artificial Sequence
  spacer sequence
PGPE

SEQ ID NO: 12 - protein, 4 aa, Artificial Sequence
  spacer sequence
FVNQ

SEQ ID NO: 13 - protein, 5 aa, Artificial Sequence
  spacer sequence
  MISC_FEATURE (1)..(5): The Xaas at positions 1-5 are independently any amino acid
XXXXX

SEQ ID NO: 14 - protein, 6 aa, Artificial Sequence
  spacer sequence
AYRPSE

SEQ ID NO: 15 - protein, 4 aa, Artificial Sequence
  spacer sequence
  MISC_FEATURE (1)..(4): The Xaas at positions 1-4 are independently any amino acid
XXXX

SEQ ID NO: 16 - protein, 5 aa, Artificial Sequence
  spacer sequence
YTPKT

SEQ ID NO: 17 - protein, 12 aa, Homo sapiens
GYGSSSRRAPQT

SEQ ID NO: 18 - protein, 8 aa, Homo sapiens
GYGSSSRR

SEQ ID NO: 19 - protein, 21 aa, Artificial Sequence
  Analog of the insulin A chain
  MISC_FEATURE (4)..(4): Xaa at position 4 is aspartic acid or glutamic acid
  MISC_FEATURE (5)..(5): Xaa at position 5 is glutamine or glutamic acid
  MISC_FEATURE (8)..(8): Xaa at position 8 is histidine, threonine or phenylalanine
  MISC_FEATURE (9)..(9): Xaa at position 9 is serine, arginine, ornithine, lysine or alanine
  MISC_FEATURE (10)..(10): Xaa at position 10 is isoleucine or serine
  MISC_FEATURE (12)..(12): Xaa at position 12 is aspartic acid or serine
  MISC_FEATURE (14)..(14): Xaa at position 14 is tyrosine, arginine, ornathine, lysine or alanine
  MISC_FEATURE (15)..(15): Xaa at position 15 is glutamine, glutamic acid, arginine, ornithine, alanine, lysine or leucine
  MISC_FEATURE (17)..(17): Xaa at position 17 is glutamine or glutamic acid
  MISC_FEATURE (18)..(18): Xaa at position 18 is methionine, asparagine, glutamine, glutamic acid, aspartic acid or threonine
  MISC_FEATURE (21)..(21): Xaa at position 21 is alanine, glycine, serine, valine, threonine, isoleucine, leucine, glutamine, glutamic acid, asparagine, aspartic acid, histidine, tryptophan, tyrosine, or methionine
GIVXXCCXXXCXLXXLXXYCX

SEQ ID NO: 20 - protein, 21 aa, Artificial Sequence
  Analog of the insulin B chain
  MISC_FEATURE (1)..(1): Xaa at position 1 is histidine or threonine
  MISC_FEATURE (5)..(5): Xaa at position 5 is alanine, glycine or serine
  MISC_FEATURE (6)..(6): Xaa at position 6 is histidine, aspartic acid, glutamic acid, homocysteic acid or cysteic acid
  MISC_FEATURE (9)..(9): Xaa at position 9 is aspartic acid, glutamine or glutamic acid
  MISC_FEATURE (10)..(10): Xaa at position 10 is alanine or threonine
  MISC_FEATURE (17)..(17): Xaa at position 17 is glutamic acid, aspartic acid or asparagine
  MISC_FEATURE (18)..(18): Xaa at position 18 is alanine, ornithine, lysine or arginine
  MISC_FEATURE (21)..(21): Xaa at position 21 is tyrosine or 4-amino-phenylalanine
XLCGXXLVXXLYLVCGXXGFX

SEQ ID NO: 21 - protein, 8 aa, Artificial Sequence
  analog of IGF-1 C peptide
  MISC_FEATURE (7)..(8): The Xaas at positions 7 and 8 are independently arginine, lysine or ornithine
GYGSSSXX

SEQ ID NO: 22 - protein, 8 aa, Artificial Sequence
  Analog of IGF-1 C peptide
GAGSSSRR

SEQ ID NO: 23 - protein, 12 aa, Artificial Sequence
  linker sequence
GAGSSSRRAPQT

SEQ ID NO: 24 - protein, 8 aa, Homo sapiens
SRVSRRSR

SEQ ID NO: 25 - protein, 21 aa, Artificial Sequence
  Analog of the insulin B chain
  MISC_FEATURE (1)..(1): Xaa at position 1 is histidine or threonine
  MISC_FEATURE (5)..(5): Xaa at position 5 is alanine, glycine or serine
  MISC_FEATURE (6)..(6): Xaa at position 6 is histidine, aspartic acid, glutamic acid, homocysteic acid or cysteic acid
  MISC_FEATURE (9)..(9): Xaa at position 9 is aspartic acid or glutamic acid
  MISC_FEATURE (10)..(10): Xaa at position 10 is alanine or threonine
  MISC_FEATURE (18)..(18): Xaa at position 18 is alanine, ornithine, lysine or arginine
  MISC_FEATURE (21)..(21): Xaa at position 21 is tyrosine or phenylalanine
XLCGXXLVXXLYLVCGDXGFX

SEQ ID NO: 26 - protein, 7 aa, Artificial Sequence
  amino acid terminal extension for insulin
  MISC_FEATURE (2)..(6): the Xaas at positions 2-6 are independently glutamic acid or aspartic acid
GXXXXXK

SEQ ID NO: 27 - protein, 7 aa, Artificial Sequence
  amio acid terminal extension for insulin
  MISC_FEATURE (1)..(5): the Xaas at positions 1-5 are independently glutamic acid or aspartic acid
XXXXXRK

SEQ ID NO: 28 - protein, 31 aa, Artificial Sequence
  Analog of IGF-1 B chain
  MISC_FEATURE (28)..(28): The Xaa at position 28 is alanine lysine, ornithine or arginine
GEEEEEKGPEHLCGAHLVDALYLVCGDXGFY

SEQ ID NO: 29 - protein, 21 aa, Artificial Sequence
  Analog of the insulin A chain
  MISC_FEATURE (4)..(4): Xaa at position 4 is aspartic acid or glutamic acid
  MISC_FEATURE (5)..(5): Xaa at position 5 is glutamine or glutamic acid
  MISC_FEATURE (8)..(8): Xaa at position 8 is histidine, threonine or phenylalanine
  MISC_FEATURE (9)..(9): Xaa at position 9 is serine, arginine, ornithine, lysine or alanine
  MISC_FEATURE (10)..(10): Xaa at position 10 is isoleucine or serine
  MISC_FEATURE (12)..(12): Xaa at position 12 is aspartic acid or serine
  MISC_FEATURE (14)..(14): Xaa at position 14 is tyrosine, arginine, ornathine, lysine or alanine
  MISC_FEATURE (15)..(15): Xaa at position 15 is glutamine, glutamic acid, arginine, ornithine, alanine, lysine or leucine
  MISC_FEATURE (17)..(17): Xaa at position 17 is glutamine or glutamic acid
  MISC_FEATURE (18)..(18): Xaa at position 18 is methionine, asparagine, glutamine, glutamic acid, aspartic acid or threonine
  MISC_FEATURE (19)..(19): Xaa at position 19 is tyrosine, 4-methoxy phenylalanine  or 4-amino-phenylalanine
  MISC_FEATURE (21)..(21): Xaa at position 21 is alanine, glycine, serine, valine, threonine, isoleucine, leucine, glutamine, glutamic acid, asparagine, aspartic acid, histidine, tryptophan, tyrosine, or methionine
GIVXXCCXXXCXLXXLXXXCX

SEQ ID NO: 30 - protein, 21 aa, Artificial Sequence
  Analog of insulin A chain
  MISC_FEATURE (8)..(8): Xaa at position 8 is  threonine or histidine
  MISC_FEATURE (19)..(19): Xaa at position 19 is tyrosine, 4-methoxy-phenylalanine or 4-amino phenylalanine
  MISC_FEATURE (21)..(21): Xaa at position 21 is asparagine or glycine
GIVEQCCXSICSLYQLENXCX

SEQ ID NO: 31 - protein, 21 aa, Artificial Sequence
  Analog of insulin B chain
  MISC_FEATURE (1)..(1): Xaa at position 1 is histidine or threonine
  MISC_FEATURE (5)..(5): Xaa at position 5 is alanine, glycine or serine
  MISC_FEATURE (6)..(6): Xaa at position 6 is histidine, aspartic acid, glutamic acid, homocysteic acid or cysteic acid
XLCGXXLVEALYLVCGERGFF

SEQ ID NO: 32 - protein, 21 aa, Artificial Sequence
  Analog of the insulin A chain
  MISC_FEATURE (8)..(8): Xaa at position 8 is histidine or threonine
  MISC_FEATURE (17)..(17): Xaa at position 17 is glutamine or glutamic acid
  MISC_FEATURE (19)..(19): Xaa at position 19 is tyrosine, 4-methoxy phenylalanine  or 4-amino-phenylalanine
  MISC_FEATURE (21)..(21): Xaa at position 21 is asparagine or glycine
GIVEQCCXSICSLYQLXNXCX

SEQ ID NO: 33 - protein, 21 aa, Artificial Sequence
  Analog of the insulin B chain
  MISC_FEATURE (1)..(1): Xaa at position 1 is histidine or threonine
  MISC_FEATURE (5)..(5): Xaa at position 5 is alanine, glycine or serine
  MISC_FEATURE (6)..(6): Xaa at position 6 is histidine, aspartic acid, glutamic acid, homocysteic acid or cysteic acid
XLCGXXLVEALYLVCGERGFF

SEQ ID NO: 34 - protein, 27 aa, Artificial Sequence
  Analog of the insulin B chain
  MISC_FEATURE (1)..(1): Xaa at position 1 is phenylalanine and desamino-phenylalanine
  MISC_FEATURE (5)..(5): Xaa at position 5 is histidine and threonine
  MISC_FEATURE (9)..(9): Xaa at position 9 is alanine, glycine or serine
  MISC_FEATURE (10)..(10): Xaa at position 10 is histidine, aspartic acid, glutamic acid, homocysteic acid or cysteic acid
XVNQXLCGXXLVEALYLVCGERGFFYT

SEQ ID NO: 35 - protein, 21 aa, Artificial Sequence
  Analog of the insulin A chain
  MISC_FEATURE (8)..(8): Xaa at position 8 is histidine or phenylalnine
  MISC_FEATURE (9)..(9): Xaa at position 9 is arginine, lysine, ornithine or alanine
  MISC_FEATURE (14)..(14): Xaa at position 14 is arginine, lysine, ornithine or alanine
  MISC_FEATURE (15)..(15): Xaa at position 15 is arginine, lysine, ornithine or leucine
  MISC_FEATURE (17)..(17): Xaa at position 17 is glutamine or glutamic acid
  MISC_FEATURE (18)..(18): Xaa at position 18 is methionine, asparagine or threonine
  MISC_FEATURE (19)..(19): Xaa at position 19 is tyrosine, 4-methoxy phenylalanine  or 4-amino-phenylalanine
  MISC_FEATURE (21)..(21): Xaa at position 21 is alanine, glycine or asparagine
GIVDECCXXSCDLXXLXXXCX

SEQ ID NO: 36 - protein, 21 aa, Artificial Sequence
  Analog of the insulin B chain
  MISC_FEATURE (1)..(1): Xaa at position 1 is histidine or threonine
  MISC_FEATURE (5)..(5): Xaa at position 5 is alanine, glycine or serine
  MISC_FEATURE (6)..(6): Xaa at position 6 is histidine, aspartic acid, glutamic acid, homocysteic acid or cysteic acid
  MISC_FEATURE (9)..(9): Xaa at position 9 is aspartic acid or glutamic acid
  MISC_FEATURE (10)..(10): Xaa at position 10 is alanine or threonine
  MISC_FEATURE (18)..(18): Xaa at position 18 is alanine, ornithine, lysine or arginine
  MISC_FEATURE (21)..(21): Xaa at position 21 is tyrosine or phenylalanine
XLCGXXLVXXLYLVCGDXGFX

SEQ ID NO: 37 - protein, 21 aa, Artificial Sequence
  Analog of the insulin A chain
  MISC_FEATURE (9)..(9): Xaa at position 9 is arginine, ornithine, or lysine
  MISC_FEATURE (14)..(14): Xaa at position 14 is arginine, ornithine, or lysine
  MISC_FEATURE (15)..(15): Xaa at position 15 is arginine, ornithine, or lysine
  MISC_FEATURE (17)..(17): Xaa at position 17 is glutamine or glutamic acid
  MISC_FEATURE (19)..(19): Xaa at position 19 is tyrosine, 4-methoxy phenylalanine  or 4-amino-phenylalanine
  MISC_FEATURE (21)..(21): Xaa at position 21 is alanine, glycine or asparagine
GIVDECCHXSCDLXXLXMXCX

SEQ ID NO: 38 - protein, 21 aa, Artificial Sequence
  Analog of the insulin B chain
  MISC_FEATURE (1)..(1): Xaa at position 1 is histidine or threonine
  MISC_FEATURE (6)..(6): Xaa at position 6 is histidine, aspartic acid, or glutamic acid
  MISC_FEATURE (18)..(18): Xaa at position 18 is alanine, ornithine, lysine or arginine
  MISC_FEATURE (21)..(21): Xaa at position 21 is tyrosine or phenylalanine
XLCGAXLVDALYLVCGDXGFX

SEQ ID NO: 39 - protein, 21 aa, Artificial Sequence
  analog of insulin B chain
  MISC_FEATURE (18)..(18): The Xaa at position 18 is ornithine, lysine or arginine
HLCGAELVDALYLVCGDXGFY

SEQ ID NO: 40 - protein, 24 aa, Artificial Sequence
  analog of IGF-1 B chain
  MISC_FEATURE (21)..(21): The Xaa at position 21 is ornithine, lysine or arginine
GPEHLCGAELVDALYLVCGDXGFY

SEQ ID NO: 41 - protein, 29 aa, Artificial Sequence
  Analog of IGF-1 B chain
  MISC_FEATURE (21)..(21): The Xaa at position 21 is ornithine, lysine or arginine
GPEHLCGAELVDALYLVCGDXGFYFNPKT

SEQ ID NO: 42 - protein, 29 aa, Artificial Sequence
  Analog of IGF-1 B chain
  MISC_FEATURE (21)..(21): The Xaa at position 21 is ornithine, lysine or arginine
GPEHLCGAELVDALYLVCGDXGFYFNKPT

SEQ ID NO: 43 - protein, 21 aa, Artificial Sequence
  Analog of the insulin A chain
  MISC_FEATURE (9)..(9): Xaa at position 9 is arginine, ornithine, or lysine
  MISC_FEATURE (14)..(14): Xaa at position 14 is arginine, ornithine, or lysine
  MISC_FEATURE (15)..(15): Xaa at position 15 is arginine, ornithine, or lysine
GIVDECCHXSCDLXXLQMYCN

SEQ ID NO: 44 - protein, 21 aa, Artificial Sequence
  Analog of the insulin A chain
  MISC_FEATURE (8)..(8): Xaa at position 8 is threonine, histidine or phenylalnine
  MISC_FEATURE (19)..(19): Xaa at position 19 is tyrosine, 4-methoxy phenylalanine  or 4-amino-phenylalanine
GIVDECCXRSCDLYQLENXCN

SEQ ID NO: 45 - protein, 21 aa, Artificial Sequence
  Analog of the insulin B chain
  MISC_FEATURE (1)..(1): Xaa at position 1 is histidine or threonine
  MISC_FEATURE (18)..(18): Xaa at position 18 is alanine, ornithine, lysine or arginine
  MISC_FEATURE (21)..(21): Xaa at position 21 is tyrosine, histidine, asparagine or phenylalanine
XLCGSHLVDALYLVCGDXGFX

SEQ ID NO: 46 - protein, 21 aa, Artificial Sequence
  Analog of the insulin A chain
  MISC_FEATURE (19)..(19): Xaa at position 19 is tyrosine, 4-methoxy phenylalanine  or 4-amino-phenylalanine
  MISC_FEATURE (21)..(21): Xaa at position 21 is alanine, glycine or asparagine
GIVEQCCHSICSLYQLENXCX

SEQ ID NO: 47 - protein, 21 aa, Homo sapiens
  MISC_FEATURE (19)..(19): The Xaa at position 19 is tyrosine, 4-methoxy-phenylalanine or 4-amino phenylalanine
  MISC_FEATURE (21)..(21): The Xaa at position 21 is alanine, glycine or asparagine
GIVDECCHRSCDLRRLEMXCX

SEQ ID NO: 48 - protein, 29 aa, Homo sapiens
GPETLCGAELVDALYLVCGDRGFYFNPKT

SEQ ID NO: 49 - protein, 8 aa, Artificial Sequence
  linker sequence
  MISC_FEATURE (1)..(1): Xaa at position1 is glycine, alanine, valine, leucine, isoleucine, proline, phenylalanine and methionine
  MISC_FEATURE (2)..(2): Xaa at position 2 is any non-aromatic amino acid
  MISC_FEATURE (7)..(8): Xaas at positions 7 and 8 are independently arginine, lysine or ornithine
XXGSSSXX

SEQ ID NO: 50 - protein, 12 aa, Artificial Sequence
  linker sequence
  MISC_FEATURE (1)..(1): Xaa at position1 is glycine, alanine, valine, leucine, isoleucine, proline, phenylalanine and methionine
  MISC_FEATURE (2)..(2): Xaa at position 2 is any non-aromatic amino acid
  MISC_FEATURE (7)..(8): Xaas at positions 7 and 8 are independently arginine, lysine or ornithine
XXGSSSXXAPQT

SEQ ID NO: 51 - protein, 29 aa, Homo sapiens
SSSSRAPPPSLPSPSRLPGPSDTPILPQK

SEQ ID NO: 52 - protein, 29 aa, Homo sapiens
SSSSKAPPPSLPSPSRLPGPSDTPILPQR

SEQ ID NO: 53 - protein, 8 aa, Artificial Sequence
  linker sequence
  MISC_FEATURE (1)..(1): Xaa at position 1 is glycine, alanine, valine, leucine, isoleucine, proline, phenylalanine and methionine
  MISC_FEATURE (2)..(2): Xaa at position 2 is any non-aromatic amino acid
XXGSSSRR

SEQ ID NO: 54 - protein, 12 aa, Artificial Sequence
  Analog of IGF-1 C peptide
  MISC_FEATURE (8)..(8): The Xaa at position 8 is arginine, lysine or ornithine
GAGSSSRXAPQT

SEQ ID NO: 55 - protein, 12 aa, Artificial Sequence
  linker sequence
  MISC_FEATURE (2)..(2): Xaa at position 2 is any non-aromatic amino acid
  MISC_FEATURE (8)..(8): Xaa at position 8 is arginine, lysine or ornithine
GXGSSSRXAPQT

SEQ ID NO: 56 - protein, 8 aa, Artificial Sequence
  linker sequence
  MISC_FEATURE (2)..(2): Xaa at position 2 is any non-aromatic amino acid
GXGSSSRR

SEQ ID NO: 57 - protein, 9 aa, Artificial Sequence
  linker sequence
GAGSSSRRA

SEQ ID NO: 58 - protein, 10 aa, Artificial Sequence
  linker sequence
GAGSSSRRAP

SEQ ID NO: 59 - protein, 11 aa, Artificial Sequence
  Analog of IGF-1 C peptide
GAGSSSRRAPQ

SEQ ID NO: 60 - protein, 12 aa, Artificial Sequence
  linker sequence
GAGSSSRRAPQT

SEQ ID NO: 61 - protein, 8 aa, Artificial Sequence
  linker sequence
PYGSSSRR

SEQ ID NO: 62 - protein, 8 aa, Artificial Sequence
  linker sequence
PAGSSSRR

SEQ ID NO: 63 - protein, 9 aa, Artificial Sequence
  linker sequence
PAGSSSRRA

SEQ ID NO: 64 - protein, 10 aa, Artificial Sequence
  linker sequence
PAGSSSRRAP

SEQ ID NO: 65 - protein, 11 aa, Artificial Sequence
  linker sequence
PAGSSSRRAPQ

SEQ ID NO: 66 - protein, 12 aa, Artificial Sequence
  linker sequence
PAGSSSRRAPQT

SEQ ID NO: 67 - protein, 28 aa, Homo sapiens
SSSSRAPPPSLPSPSRLPGPSDTPILPQ

SEQ ID NO: 68 - protein, 29 aa, Homo sapiens
  MISC_FEATURE (5)..(5): Xaa at position 5 is lysine or Arginine
  MISC_FEATURE (29)..(29): Xaa at position 29 is lysine or Arginine
SSSSXAPPPSLPSPSRLPGPSDTPILPQX

SEQ ID NO: 69 - protein, 12 aa, Artificial Sequence
  linker sequence
  MISC_FEATURE (7)..(8): Xaas at positions 7 and 8 are independently arginine, lysine or ornithine
GYGSSSXXAPQT

SEQ ID NO: 70 - protein, 4 aa, Homo sapiens
YTPK

SEQ ID NO: 71 - protein, 4 aa, Homo sapiens
FNKP

SEQ ID NO: 72 - protein, 29 aa, Artificial Sequence
  glucagon analogue
  MISC_FEATURE (1)..(1): Xaa at position 1 = His, D-histidine, desaminohistidine, hydroxyl-histidine, acetyl-histidine, homo-histidine or alpha, alpha-dimethyl imidiazole acetic acid (DMIA), N-methyl histidine, alpha-methyl histidine, or imidazole acetic acid
  MISC_FEATURE (2)..(2): Xaa at position 2 = Ser, D-serine, Ala, D-alanine, Val, glycine, n-methyl serine, aminoisobutyric acid (AIB) or N-methyl alanine
  MISC_FEATURE (3)..(3): Xaa at position 3 is Gln, Glu, Orn or  Nle
  MISC_FEATURE (10)..(10): Xaa at position 10 = Tyr, Val or Trp
  MISC_FEATURE (12)..(12): Xaa at position 12 = Ser, Lys or Arg
  MISC_FEATURE (15)..(15): Xaa at position 15 = Asp, Glu, cysteic acid, homoglutamic acid and homocysteic acid
  MISC_FEATURE (16)..(16): Xaa at position 16 = Ser, Gly, Glu, Gln, homoglutamic acid or homocysteic acid
  MISC_FEATURE (17)..(17): Xaa at position 17 = Arg, Gln, Lys, Cys, Orn, homocycstein or acetyl phenylalanine
  MISC_FEATURE (18)..(18): Xaa at position 18 = Arg, Ala,Lys, Cys, Orn, homocycstein or acetyl phenylalanine
  MISC_FEATURE (20)..(20): Xaa at position 20 = Gln, Lys, arginine, ornithine or citrulline
  MISC_FEATURE (21)..(21): Xaa at position 21 = Gln, Glu, Asp, Lys, Cys, Orn, homocycstein or acetyl phenyalanine
  MISC_FEATURE (23)..(23): Xaa at position 23 is Val or Ile
  MISC_FEATURE (24)..(24): Xaa at position 24 = Ala, Gln, Glu, Lys, Cys, Orn, homocycstein or acetyl phenyalanine
  MISC_FEATURE (27)..(27): Xaa at position 27 = Met, Leu, Val or Nle
  MISC_FEATURE (28)..(28): Xaa at position 28 = Asn, Lys or Asp
  MISC_FEATURE (29)..(29): Xaa at position 29 is Thr, Gly, Lys, Cys, Orn, homocycstein or acetyl phenyalanine
XXXGTFTSDXSXYLXXXXAXXFXXWLXXX

SEQ ID NO: 73 - protein, 21 aa, Artificial Sequence
  Analog of Insulin A chain
  MISC_FEATURE (8)..(8): Xaa at position 8 is  threonine or histidine
  MISC_FEATURE (9)..(9): Xaa at position 9 is  valine or tyrosine
  MISC_FEATURE (21)..(21): Xaa at position 21 is asparagine or glycine
GIVEQCCXXICSLYQLENYCX

SEQ ID NO: 74 - protein, 21 aa, Artificial Sequence
  Analog of the insulin A chain
  MISC_FEATURE (8)..(8): Xaa at position 8 is histidine or phenylalnine
  MISC_FEATURE (9)..(9): Xaa at position 9 is arginine, lysine, ornithine or alanine
  MISC_FEATURE (19)..(19): Xaa at position 19 is tyrosine, 4-methoxy phenylalanine  or 4-amino-phenylalanine
  MISC_FEATURE (21)..(21): Xaa at position 21 is alanine, glycine or asparagine
GIVDECCXXSCDLRRLEMXCX

SEQ ID NO: 75 - protein, 21 aa, Artificial Sequence
  Analog of the insulin B chain
  MISC_FEATURE (1)..(1): Xaa at position 1 is histidine or threonine
  MISC_FEATURE (6)..(6): Xaa at position 6 is histidine, aspartic acid, glutamic acid, homocysteic acid or cysteic acid
  MISC_FEATURE (18)..(18): Xaa at position 18 is alanine, ornithine, lysine or arginine
  misc_feature (21)..(21): Xaa can be any naturally occurring amino acid
XLCGAXLVDALYLVCGDXGFX

SEQ ID NO: 76 - protein, 8 aa, Artificial Sequence
  Analog of IGF-1 C peptide
  MISC_FEATURE (7)..(8): The Xaas at positions 7 and 8 are independently arginine, lysine or ornithine
GAGSSSXX

SEQ ID NO: 77 - protein, 12 aa, Artificial Sequence
  Analog of IGF-1 C peptide
  MISC_FEATURE (7)..(8): The Xaas at positions 7 and 8 are independently arginine, lysine or ornithine
GYGSSSXXAPQT

SEQ ID NO: 78 - protein, 10 aa, Artificial Sequence
  peptide fragment representing the carboxy terminal 10 amino acids of Exendin-4
GPSSGAPPPS

SEQ ID NO: 79 - protein, 10 aa, Artificial Sequence
  peptide fragment representing the carboxy terminal 10 amino acids of Exendin-4
  MOD_RES (10)..(10): AMIDATION
GPSSGAPPPS

SEQ ID NO: 80 - protein, 11 aa, Artificial Sequence
  peptide fragment representing the carboxy terminal 10 amino acids of Exendin-4
  MISC_FEATURE (11)..(11): pegylated
GPSSGAPPPSC

SEQ ID NO: 81 - protein, 29 aa, Homo sapiens
  MISC_FEATURE (15)..(15): Xaa at position 15 = Asp, Glu, homoglutamic acid, cysteic acid or homocysteic acid
  MISC_FEATURE (16)..(16): Xaa at position 16 = Ser, Glu, Gln, homoglutamic acid or homocysteic acid
  MISC_FEATURE (20)..(20): Xaa at position 20 = Gln or Lys
  MISC_FEATURE (24)..(24): Xaa at position 24 = Gln or Glu
  MISC_FEATURE (28)..(28): Xaa at position 28 = Asn, Lys or an acidic amino acid
  MISC_FEATURE (29)..(29): Xaa at position 29 = Thr, Gly or an acidic amino acid
HSQGTFTSDYSKYLXXRRAXDFVXWLMXX

SEQ ID NO: 82 - protein, 29 aa, Homo sapiens
  MISC_FEATURE (15)..(15): Xaa at position 15 = Asp, Glu, cysteic acid, homoglutamic acid or homocysteic acid
  MISC_FEATURE (16)..(16): Xaa at position 16 = Ser, Glu, Gln, homoglutamic acid or homocysteic acid
  MISC_FEATURE (20)..(20): Xaa at position 20 = Gln or Lys
  MISC_FEATURE (24)..(24): Xaa at position 24 = Gln or Glu
  MISC_FEATURE (28)..(28): Xaa at position 28 = Asn, Asp or Lys
  MISC_FEATURE (29)..(29): Xaa at position 29 is Thr or Gly
HSQGTFTSDYSKYLDXRRAXDFVXWLMXX

SEQ ID NO: 83 - protein, 29 aa, Artificial Sequence
  glucagon analogue
  MISC_FEATURE (3)..(3): Xaa at position 3= Glu, Orn or Nle
  MISC_FEATURE (15)..(15): Xaa at position 15 = Asp, Glu, homoglutamic acid, cysteic acid or homocysteic acid
  MISC_FEATURE (16)..(16): Xaa at position 16 = Ser, Glu, Gln, homoglutamic acid or homocysteic acid
  MISC_FEATURE (20)..(20): Xaa at position 20 = Gln or Lys
  MISC_FEATURE (24)..(24): Xaa at position 24 = Gln or Glu
  MISC_FEATURE (28)..(28): Xaa at position 28 = Asn, Lys or an acidic amino acid
  MISC_FEATURE (29)..(29): Xaa at position 29 = Thr or an acidic amino acid
HSXGTFTSDYSKYLXXRRAXDFVXWLMXX

SEQ ID NO: 84 - protein, 29 aa, Artificial Sequence
  Glucagon analogue
  MISC_FEATURE (15)..(15): Xaa at position 15 is Glu or Asp
  MISC_FEATURE (28)..(28): Xaa at position 28 is Glu or Asp
  MOD_RES (29)..(29): AMIDATION
HSQGTFTSDYSKYLXERRAQDFVQWLMXT

SEQ ID NO: 85 - protein, 29 aa, Artificial Sequence
  glucagon analogue
  MISC_FEATURE (12)..(16): lactam ring formed between side chain of Lys 12 and Glu 16
  MISC_FEATURE (15)..(15): Xaa at position 15 is Glu or Asp
  MISC_FEATURE (28)..(28): Xaa at position 28 is Glu or Asp
  MOD_RES (29)..(29): AMIDATION
HSQGTFTSDYSKYLXERRAQDFVQWLMXT

SEQ ID NO: 86 - protein, 29 aa, Artificial Sequence
  glucagon analogue
  MISC_FEATURE (15)..(15): Xaa at position 15 is Glu or Asp
  MISC_FEATURE (16)..(20): lactam ring formed between side chain of Glu 16 and Lys 20
  MISC_FEATURE (28)..(28): Xaa at position 28 is Glu or Asp
  MOD_RES (29)..(29): AMIDATION
HSQGTFTSDYSKYLXERRAKDFVQWLMXT

SEQ ID NO: 87 - protein, 29 aa, Artificial Sequence
  glucagon analogue
  MISC_FEATURE (15)..(15): Xaa at position 15 is Glu or Asp
  MISC_FEATURE (20)..(24): lactam ring formed between side chain of Lys 20 and Glu 24
  MISC_FEATURE (28)..(28): Xaa at position 28 is Glu or Asp
  MOD_RES (29)..(29): AMIDATION
HSQGTFTSDYSKYLXSRRAKDFVEWLMXT

SEQ ID NO: 88 - protein, 29 aa, Artificial Sequence
  glucagon analogue
  MISC_FEATURE (15)..(15): Xaa at position 15 is Glu or Asp
  MISC_FEATURE (24)..(28): lactam ring formed between side chain of Glu 24 and Lys 28
  MISC_FEATURE (29)..(29): Xaa at position 29 is Glu or Thr
  MOD_RES (29)..(29): AMIDATION
HSQGTFTSDYSKYLXSRRAQDFVEWLMKX

SEQ ID NO: 89 - protein, 29 aa, Homo sapiens
  MISC_FEATURE (27)..(27): Xaa at position 27 is Met, Leu or Nle
HSQGTFTSDYSKYLDSRRAQDFVQWLXNT

SEQ ID NO: 90 - protein, 29 aa, Artificial Sequence
  glucagon analogue
  MISC_FEATURE (16)..(16): Xaa is Glu, Gln, homoglutamic acid or homocysteic acid
  MISC_FEATURE (17)..(17): Xaa is Arg, Cys, Orn, homocysteine or acetyl phenylalanine
  MISC_FEATURE (27)..(27): Xaa at position 27 is Met, Leu or Nle
HSQGTFTSDYSKYLDXXRAQDFVQWLXNT

SEQ ID NO: 91 - protein, 29 aa, Artificial Sequence
  Glucagon analogue
  MISC_FEATURE (16)..(16): Xaa is Glu, Gln, homoglutamic acid or homocysteic acid
  MISC_FEATURE (21)..(21): Xaa is Asp, Cys, Orn, homocysteine or acetyl phenyalanine
  MISC_FEATURE (27)..(27): Xaa at position 27 is Met, Leu or Nle
HSQGTFTSDYSKYLDXRRAQXFVQWLXNT

SEQ ID NO: 92 - protein, 29 aa, Artificial Sequence
  glucagon analog
  MISC_FEATURE (16)..(16): Xaa is Glu, Gln, homoglutamic acid or homocysteic acid
  MISC_FEATURE (24)..(24): Xaa is Gln, Cys, Orn, homocysteine or acetyl phenylalanine
  MISC_FEATURE (27)..(27): Xaa at postion 27 is Met, Leu or Nle
HSQGTFTSDYSKYLDXRRAQDFVXWLXNT

SEQ ID NO: 93 - protein, 29 aa, Artificial Sequence
  Glucagon analogue
  MISC_FEATURE (16)..(16): Xaa is Glu, Gln, homoglutamic acid or homocysteic acid
  MISC_FEATURE (21)..(21): Xaa is Asp, Cys, Orn, homocysteine or acetyl phenyalanine
  MISC_FEATURE (24)..(24): Xaa is Gln, Cys, Orn, homocysteine or acetyl phenyalanine
  MISC_FEATURE (27)..(27): Xaa at position 27 is Met, Leu or Nle
HSQGTFTSDYSKYLDXRRAQXFVXWLXNT

SEQ ID NO: 94 - protein, 29 aa, Artificial Sequence
  Glucagon analogue
  MISC_FEATURE (21)..(21): Xaa is Asp, Cys, Orn, homocysteine or acetyl phenyalanine
  MISC_FEATURE (27)..(27): Xaa is Met, Leu or Nle
HSQGTFTSDYSKYLDERRAQXFVQWLXNT

SEQ ID NO: 95 - protein, 29 aa, Artificial Sequence
  Glucagon analogue
  MISC_FEATURE (24)..(24): Xaa at position 24 is Gln, Cys, Orn, homocysteine or acetyl phenylalanine
  MISC_FEATURE (27)..(27): Xaa at position 27 is Met, Leu or Nle
HSQGTFTSDYSKYLDERRAQDFVXWLXNT

SEQ ID NO: 96 - protein, 29 aa, Artificial Sequence
  Glucagon analogue
  MISC_FEATURE (16)..(16): Xaa at position 16 is Glu, Gln, homoglutamic acid or homocysteic acid
HSQGTFTSDYSKYLDXRRAQDFVQWLMNT

SEQ ID NO: 97 - protein, 29 aa, Artificial Sequence
  Glucagon analogue
  MISC_FEATURE (27)..(27): Xaa at position 27 = Met, Leu or Nle
HSQGTFTSDYSKYLDERRAQDFVQWLXNT

SEQ ID NO: 98 - protein, 29 aa, Artificial Sequence
  Glucagon analogue
HSQGTFTSDYSKYLDERRAQDFVQWLMNT

SEQ ID NO: 99 - protein, 29 aa, Artificial Sequence
  Glucagon analogue
  MOD_RES (29)..(29): AMIDATION
HSQGTFTSDYSKYLDERRAQDFVQWLMNT

SEQ ID NO: 100 - protein, 29 aa, Artificial Sequence
  glucagon analogue
  MISC_FEATURE (12)..(16): lactam ring formed between side chain of Lys 12 and Glu 16
HSQGTFTSDYSKYLDERRAQDFVQWLMNT

SEQ ID NO: 101 - protein, 29 aa, Artificial Sequence
  glucagon analogue
  MISC_FEATURE (16)..(20): lactam ring formed between side chain of Glu 16 and Lys 20
HSQGTFTSDYSKYLDERRAKDFVQWLMNT

SEQ ID NO: 102 - protein, 29 aa, Artificial Sequence
  glucagon analogue
  MISC_FEATURE (20)..(24): lactam ring formed between side chain of Lys 20 and Glu 24
HSQGTFTSDYSKYLDSRRAKDFVEWLMNT

SEQ ID NO: 103 - protein, 29 aa, Homo sapiens
  MISC_FEATURE (24)..(28): lactam ring formed between side chain of Glu 24 and Lys 28
HSQGTFTSDYSKYLDSRRAQDFVEWLMKT

SEQ ID NO: 104 - protein, 29 aa, Homo sapiens
  MISC_FEATURE (12)..(16): lactam ring formed between side chain of Lys 12 and Glu 16
  MISC_FEATURE (20)..(24): lactam ring formed between side chain of Lys 20 and Glu 24
HSQGTFTSDYSKYLDERRAKDFVEWLMNT

SEQ ID NO: 105 - protein, 29 aa, Homo sapiens
  MISC_FEATURE (16)..(20): lactam ring formed between side chain of Lys 12 and Glu 16
  MISC_FEATURE (24)..(28): lactam ring formed between side chain of Glu 24 and Lys 28
HSQGTFTSDYSKYLDERRADDFVEWLMKT

SEQ ID NO: 106 - protein, 29 aa, Homo sapiens
  MISC_FEATURE (16)..(20): lactam ring formed between side chain of Glu 16 and Lys 20
  MISC_FEATURE (24)..(28): lactam ring formed between side chain of Glu 24 and Lys 28
HSQGTFTSDYSKYLDERRAKDFVEWLMKT

SEQ ID NO: 107 - protein, 30 aa, Artificial Sequence
  Glucagon analogue
  MISC_FEATURE (30)..(30): Xaa = any amino acid
  MOD_RES (30)..(30): AMIDATION
HSQGTFTSDYSKYLDERRAQDFVQWLMNTX

SEQ ID NO: 108 - protein, 29 aa, Homo sapiens
  MISC_FEATURE (16)..(16): Xaa at position 16 = Ser, Glu, Gln, homoglutamic acid or homocysteic acid
  MISC_FEATURE (20)..(20): Xaa at position 20 = glutamine, lysine, arginine, ornithine or citrulline
  MISC_FEATURE (24)..(24): Xaa at position 24 = Gln or Glu
  MISC_FEATURE (28)..(28): Xaa at position 28 = Asn, Asp or Lys
  MISC_FEATURE (29)..(29): Xaa at position 29 = Thr or Gly
HSQGTFTSDYSKYLDXRRAXDFVXWLMXX

SEQ ID NO: 109 - protein, 29 aa, Artificial Sequence
  glucagon analogue
  MISC_FEATURE (12)..(16): lactam ring formed between side chain of Lys 12 and Glu 16
  MISC_FEATURE (28)..(28): Xaa at position 28 is Asp or Asn
  MISC_FEATURE (29)..(29): Xaa at position 29 is Thr or Gly
HSQGTFTSDYSKYLDERRAQDFVQWLMXX

SEQ ID NO: 110 - protein, 29 aa, Artificial Sequence
  glucagon analogue
  MISC_FEATURE (16)..(20): lactam ring formed between side chain of Glu 16 and Lys 20
  MISC_FEATURE (28)..(28): Xaa at position 28 is Asp or Asn
  MISC_FEATURE (29)..(29): Xaa at position 29 is Thr or Gly
HSQGTFTSDYSKYLDERRAKDFVQWLMXX

SEQ ID NO: 111 - protein, 29 aa, Artificial Sequence
  glucagon analogue
  MISC_FEATURE (20)..(24): lactam ring formed between side chain of Lys 20 and Glu 24
  MISC_FEATURE (28)..(28): Xaa at position 28 is Asp or Asn
  MISC_FEATURE (29)..(29): Xaa at position 29 is Thr or Gly
HSQGTFTSDYSKYLDSRRAKDFVEWLMXX

SEQ ID NO: 112 - protein, 29 aa, Artificial Sequence
  glucagon analogue
  MISC_FEATURE (24)..(28): lactam ring formed between side chain of Glu 24 and Lys 28
  MISC_FEATURE (29)..(29): Xaa at position 29 is Thr or Gly
HSQGTFTSDYSKYLDSRRAQDFVEWLMKX

SEQ ID NO: 113 - protein, 29 aa, Homo sapiens
  MISC_FEATURE (16)..(16): Xaa at position 16 = Ser, Glu, Gln, homoglutamic acid or homocysteic acid
  MISC_FEATURE (20)..(20): Xaa at position 20 = glutamine, lysine, arginine, ornithine or citrulline
  MISC_FEATURE (24)..(24): Xaa at position 24 = Gln or Glu
  MISC_FEATURE (28)..(28): Xaa at position 28 = Asn, Asp or Lys
  MISC_FEATURE (29)..(29): Xaa at position 29 = Thr or Gly
HSQGTFTSDYSKYLDXRRAXDFVXWLMXX

SEQ ID NO: 114 - protein, 29 aa, Homo sapiens
HSQGTFTSDYSKYLDERRAKDFVQWLMNT

SEQ ID NO: 115 - protein, 29 aa, Artificial Sequence
  glucagon analogue
HSQGTFTSDYSKYLDSRRAKDFVEWLMNT

SEQ ID NO: 116 - protein, 29 aa, Artificial Sequence
  glucagon analogue
HSQGTFTSDYSKYLDSRRAQDFVEWLMKT

SEQ ID NO: 117 - protein, 8 aa, Artificial Sequence
  peptide fragment representing the carboxy terminal 8 amino acids of oxyntomodulin
KRNRNNIA

SEQ ID NO: 118 - protein, 4 aa, Artificial Sequence
  peptide fragment representing the amino 4 amino acids of oxyntomodulin carboxy terminus of SEQ ID NO: 27
KRNR

SEQ ID NO: 119 - protein, 29 aa, homo sapiens
HSQGTFTSDYSKYLDERRAKDFVQWLMNT

SEQ ID NO: 120 - protein, 29 aa, Artificial Sequence
  glucagon analogue
  MISC_FEATURE (1)..(1): Xaa at position 1 = His, D-histidine, desaminohistidine, hydroxyl-histidine, acetyl-histidine, homo-histidine or alpha, alpha-dimethyl imidiazole acetic acid (DMIA), N-methyl histidine, alpha-methyl histidine, or imidazole acetic acid
  MISC_FEATURE (2)..(2): Xaa at position 2 = Ser, D-serine, Ala, D-alanine, Val, glycine, n-methyl serine, aminoisobutyric acid (AIB) or N-methyl alanine
  MISC_FEATURE (3)..(3): Xaa at position 3 is Gln, Glu, Orn or  Nle
  MISC_FEATURE (15)..(15): Xaa at position 15 = Asp, Glu, cysteic acid, homoglutamic acid and homocysteic acid
  MISC_FEATURE (16)..(16): Xaa at position 16 = Ser, Glu, Gln, homoglutamic acid or homocysteic acid
  MISC_FEATURE (20)..(20): Xaa at position 20 = Gln, Lys, arginine, ornithine or citrulline
  MISC_FEATURE (21)..(21): Xaa at position 21 = Gln, Glu, Asp, Lys, Cys, Orn, homocycstein or acetyl phenyalanine
  MISC_FEATURE (23)..(23): Xaa at position 23 is Val or Ile
  MISC_FEATURE (24)..(24): Xaa at position 24 = Ala, Gln, Glu, Lys, Cys, Orn, homocycstein or acetyl phenyalanine
  MISC_FEATURE (27)..(27): Xaa at position 27 = Met, Leu or Nle
  MISC_FEATURE (28)..(28): Xaa at position 28 = Asn, Lys or Asp
  MISC_FEATURE (29)..(29): Xaa at position 29 is Thr or Gly, Lys, Cys, Orn, homocycstein or acetyl phenyalanine
XXXGTFTSDYSKYLXXRRAXXFXXWLXXX

SEQ ID NO: 121 - protein, 38 aa, Artificial Sequence
  glucagon analogue
  MISC_FEATURE (15)..(15): Xaa at position 15 = Asp, Glu, homoglutamic acid, cysteic acid or homocysteic acid
  MISC_FEATURE (16)..(16): Xaa at position 16 = Ser, Glu, Gln, homoglutamic acid or homocysteic acid
  MISC_FEATURE (20)..(20): Xaa at position 20 = Gln or Lys
  MISC_FEATURE (24)..(24): Xaa at position 24 = Gln or Glu
  MISC_FEATURE (28)..(28): Xaa at position 28 = Asn, Lys or Asp
HSQGTFTSDYSKYLXXRRAXDFVXWLMXGGPSSGPPPS

SEQ ID NO: 122 - protein, 29 aa, Artificial Sequence
  glucagon analogue
  MISC_FEATURE (16)..(16): Xaa at position 16 = Ser, Glu, Gln, homoglutamic acid or homocysteic acid
  MISC_FEATURE (20)..(20): Xaa at position 20 = Gln or Lys
  MISC_FEATURE (21)..(21): Xaa at position 21 = Asp, Lys, Cys, Orn, homocycstein or acetyl phenyalanine
  MISC_FEATURE (24)..(24): Xaa at position 24 = Gln, Lys, Cys, Orn, homocycstein or acetyl phenyalanine
  MISC_FEATURE (27)..(27): Xaa at position 27 = Met, Leu or Nle
HSQGTFTSDYSKYLDXRRAXXFVXWLXNT

SEQ ID NO: 123 - protein, 29 aa, Artificial Sequence
  glucagon analogue
  MISC_FEATURE (15)..(15): Xaa at position 15 = Asp, Glu, homoglutamic acid, cysteic acid or homocysteic acid
  MISC_FEATURE (16)..(16): Xaa at position 16 = Ser, Glu, Gln, homoglutamic acid or homocysteic acid
  MISC_FEATURE (20)..(20): Xaa at position 20 = Gln, Lys, Arg, Orn, or citrulline
  MISC_FEATURE (21)..(21): Xaa at position 21 = Asp, Glu, homoglutamic acid, or homocysteic acid
  MISC_FEATURE (24)..(24): Xaa at position 24 = Gln or Glu
  MISC_FEATURE (28)..(28): Xaa at position 28 = Asn, Lys or an acidic amino acid
  MISC_FEATURE (29)..(29): Xaa at position 29 = Thr, Gly or an acidic amino acid
HSQGTFTSDYSKYLXXRRAXXFVXWLMXX

SEQ ID NO: 124 - protein, 29 aa, Homo sapiens
HSQGTFTSDYSKYLDERRAKDFVQWLMNT

SEQ ID NO: 125 - protein, 29 aa, Artificial Sequence
  glucagon analogue
HSQGTFTSDYSKYLDSRRAKDFVEWLMNT

SEQ ID NO: 126 - protein, 29 aa, Artificial Sequence
  glucagon analogue
HSQGTFTSDYSKYLDSRRAQDFVEWLMKT

SEQ ID NO: 127 - protein, 29 aa, Artificial Sequence
  Glucagon analogue
  MISC_FEATURE (2)..(2): Xaa is d-serine, alanine, glycine, n-methyl serine and aminoisobutyric acid
  MOD_RES (29)..(29): AMIDATION
HXQGTFTSDYSKYLDERRAQDFVQWLMNT

SEQ ID NO: 128 - protein, 29 aa, Artificial Sequence
  Glucagon analogue
  MISC_FEATURE (2)..(2): Xaa is aminoisobutyric acid
  MOD_RES (29)..(29): AMIDATION
HXQGTFTSDYSKYLDERRAQDFVQWLMNT

SEQ ID NO: 129 - protein, 39 aa, Artificial Sequence
  Glucagon analogue
  MISC_FEATURE (27)..(27): Xaa is Met, Leu or Nle
HSQGTFTSDYSKYLDERRAQDFVQWLXNTGPSSGAPPPS

SEQ ID NO: 130 - protein, 37 aa, Artificial Sequence
  Glucagon analogue
  MISC_FEATURE (27)..(27): Xaa is Met, Leu or Nle
HSQGTFTSDYSKYLDERRAQDFVQWLXNTKRNRNNIA

SEQ ID NO: 131 - protein, 33 aa, Artificial Sequence
  Glucagon analogue
  MISC_FEATURE (27)..(27): Xaa is Met, Leu or Nle
HSQGTFTSDYSKYLDERRAQDFVQWLXNTKRNR

SEQ ID NO: 132 - protein, 88 aa, Artificial Sequence
  Insulin conjugate
HAEGTFTSDVSSYLEEQAAREFIAWLVRGRGGPEHLCGAHLVDALYLVCGDRGFYFNDRGAGSSSRRGIVDECCHRSCDLRRLENYCN

SEQ ID NO: 133 - protein, 88 aa, Artificial Sequence
  Insulin conjugate
HAEGTFTSDVSSYLEEQAAREFIAWLVRGRGGPEHLCGAHLVDALYLVCGDRGFYFNDRGAGSSSRRGIVDECCHRSCDLRRLENACN

SEQ ID NO: 134 - protein, 88 aa, Artificial Sequence
  Insulin conjugate
HAEGTFTSDVSSYLEEQAAREAIAWLVRGRGGPEHLCGAHLVDALYLVCGDRGFYFNDRGAGSSSRRGIVDECCHRSCDLRRLENYCN

SEQ ID NO: 135 - protein, 86 aa, Artificial Sequence
  Insulin conjugate
HSQGTFTSDYSKYLDSRRAQDFVQWLMNTGPEHLCGAHLVDALYLVCGDRGFYFNDRGAGSSSRRGIVDECCHRSCDLRRLENYCN

SEQ ID NO: 136 - protein, 86 aa, Artificial Sequence
  Insulin conjugate
HSQGTFTSDYSKYLDSRRAQDFVQWLMNTGPEHLCGAHLVDALYLVCGDRGFYFNDRGAGSSSRRGIVDECCHRSCDLRRLENACN

SEQ ID NO: 137 - protein, 86 aa, Artificial Sequence
  Insulin conjugate
HSEGTFTSDYSKYLDSRRAQDFVQWLMNTGPEHLCGAHLVDALYLVCGDRGFYFNDRGAGSSSRRGIVDECCHRSCDLRRLENYCN

SEQ ID NO: 138 - protein, 86 aa, Artificial Sequence
  Insulin conjugate
HSQGTFTSDYSKYLDERRAQDFVQWLMNTGPEHLCGAHLVDALYLVCGDRGFYFNDRGAGSSSRRGIVDECCHRSCDLRRLENYCN

SEQ ID NO: 139 - protein, 90 aa, Artificial Sequence
  Conjugate of GLP-1 and insulin
HAEGTFTSDVSSYLEEQAAREFIAWLVRGRGFVNQHLCGSHLVEALYLVCGERGFFYTPKTGAGSSSRRGIVEQCCTSICSLYQLENYCN

SEQ ID NO: 140 - protein, 88 aa, Artificial Sequence
  Conjugate of glucagon and insulin
HSQGTFTSDYSKYLDSRRAQDFVQWLMNTFVNQHLCGSHLVEALYLVCGERGFFYTPKTGAGSSSRRGIVEQCCTSICSLYQLENYCN

SEQ ID NO: 141 - protein, 35 aa, Homo sapiens
RREAEDLQVGQVELGGGPGAGSLQPLALEGSLQKR

SEQ ID NO: 142 - protein, 23 aa, Artificial Sequence
  Analog of the insulin B chain
  MISC_FEATURE (1)..(1): Xaa at position 1 is histidine or threonine
  MISC_FEATURE (5)..(5): Xaa at position 5 is alanine, glycine or serine
  MISC_FEATURE (6)..(6): Xaa at position 6 is histidine, aspartic acid, glutamic acid, homocysteic acid or cysteic acid
  MISC_FEATURE (9)..(9): Xaa at position 9 is aspartic acid, glutamine or glutamic acid
  MISC_FEATURE (10)..(10): Xaa at position 10 is alanine or threonine
  MISC_FEATURE (17)..(17): Xaa at position 12 is glutamic acid, aspartic acid or asparagine
  MISC_FEATURE (18)..(18): Xaa at position 18 is alanine, ornithine, lysine or arginine
  MISC_FEATURE (21)..(21): Xaa at position 21 is tyrosine or 4-amino-phenylalanine
XLCGXXLVXXLYLVCGXXGFXYT

SEQ ID NO: 143 - protein, 59 aa, Artificial Sequence
  Single chain insulin analog
FVNQHLCGSHLVEALYLVCGERGFFYTPKTGAGSSSRRGIVEQCCTSICSLYQLENYCN

SEQ ID NO: 144 - protein, 57 aa, Artificial Sequence
  Single chain insulin analog
  MISC_FEATURE (4)..(4): Xaa at position 4 is histidine or threonine
  MISC_FEATURE (9)..(9): Xaa at position 9 is ihistidine, aspartic acid, glutamic acid, homocysteic acid or cysteic acid
  MISC_FEATURE (21)..(21): Xaa at position 21 is alanine ornithine or arginine
  MISC_FEATURE (27)..(27): Xaa at position 21 is lysine or aspartic acid
  MISC_FEATURE (28)..(28): Xaa at position 21 is proline, ornithine or arginine
  MISC_FEATURE (44)..(44): Xaa at position 21 is phenylalanine or histidine
GPEXLCGAXLVDALYLVCGDXGFYFNXXGAGSSSRRGIVDECCXRSCDLRRLENYCN

SEQ ID NO: 145 - protein, 57 aa, Artificial Sequence
  Single chain insulin analog
GPEHLCGAHLVDALYLVCGDRGFYFNDRGAGSSSRRGIVDECCHRSCDLRRLENYCN

SEQ ID NO: 146 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDERAAQDFVQWLMNT

SEQ ID NO: 147 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDERAAKDFVQWLMNT

SEQ ID NO: 148 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDKRAAEDFVQWLMNT

SEQ ID NO: 149 - protein, 29 aa, Artificial Sequence
  glucagon analog
  MISC_FEATURE: c-term amidation
HSEGTFTSDYSKYLDEQAAKEFIAWLMNT

SEQ ID NO: 150 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDEQAAKEFIAWLMNT

SEQ ID NO: 151 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDEQAAKEFIAWLMNT

SEQ ID NO: 152 - protein, 29 aa, Artificial Sequence
  glucagon analog
  MISC_FEATURE: c-term amidation
HSEGTFTSDYSKYLDEQAAKEFIAWLVKG

SEQ ID NO: 153 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDEQAAKEFIAWLVKG

SEQ ID NO: 154 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDEQAAKEFIAWLVKG

SEQ ID NO: 155 - protein, 29 aa, Artificial Sequence
  glucagon analog
  MISC_FEATURE: c-term amidation
  MOD_RES (1)..(1): (Des-amino)His
XSEGTFTSDYSKYLDERRAQDFVQWLMNT

SEQ ID NO: 156 - protein, 29 aa, Artificial Sequence
  glucagon analog
  MISC_FEATURE: c-term amidation
  MOD_RES (1)..(1): (Des-amino)His
XSEGTFTSDYSKYLDERRAKDFVQWLMNT

SEQ ID NO: 157 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERRAKDFVQWLMNT

SEQ ID NO: 158 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERRAQDFVQWLMNT

SEQ ID NO: 159 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERRAKDFVQWLMNT

SEQ ID NO: 160 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRRAEDFVQWLMNT

SEQ ID NO: 161 - protein, 29 aa, Artificial Sequence
  glucagon analog
  MISC_FEATURE: c-term amidation
  MOD_RES (1)..(1): (Des-amino)His
XSEGTFTSDYSKYLDERAAKDFVQWLMNT

SEQ ID NO: 162 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERAAKDFVQWLMNT

SEQ ID NO: 163 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERAAQDFVQWLMNT

SEQ ID NO: 164 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERAAKDFVQWLMNT

SEQ ID NO: 165 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRAAEDFVQWLMNT

SEQ ID NO: 166 - protein, 29 aa, Artificial Sequence
  glucagon analog
  MISC_FEATURE: c-term amidation
  MOD_RES (1)..(1): (Des-amino)His
XSEGTFTSDYSKYLDEQAAKEFIAWLMNT

SEQ ID NO: 167 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDEQAAKEFIAWLMNT

SEQ ID NO: 168 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDEQAAKEFIAWLMNT

SEQ ID NO: 169 - protein, 29 aa, Artificial Sequence
  glucagon analog
  MISC_FEATURE: c-term amidation
  MOD_RES (1)..(1): (Des-amino)His
XSEGTFTSDYSKYLDEQAAKEFIAWLVKG

SEQ ID NO: 170 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDEQAAKEFIAWLVKG

SEQ ID NO: 171 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDEQAAKEFIAWLVKG

SEQ ID NO: 172 - protein, 29 aa, Artificial Sequence
  glucagon analog
  MISC_FEATURE: c-term amidation
  MOD_RES (2)..(2): Aminoisobutyric acid
HXEGTFTSDYSKYLDERRAQDFVQWLMNT

SEQ ID NO: 173 - protein, 29 aa, Artificial Sequence
  glucagon analog
  MISC_FEATURE: c-term amidation
  MOD_RES (2)..(2): Aminoisobutyric acid
HXEGTFTSDYSKYLDERRAKDFVQWLMNT

SEQ ID NO: 174 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERRAKDFVQWLMNT

SEQ ID NO: 175 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAQDFVQWLMNT

SEQ ID NO: 176 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAKDFVQWLMNT

SEQ ID NO: 177 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDKRRAEDFVQWLMNT

SEQ ID NO: 178 - protein, 29 aa, Artificial Sequence
  glucagon analog
  MISC_FEATURE: c-term amidation
  MOD_RES (2)..(2): Aminoisobutyric acid
HXEGTFTSDYSKYLDERAAKDFVQWLMNT

SEQ ID NO: 179 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERAAKDFVQWLMNT

SEQ ID NO: 180 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERAAQDFVQWLMNT

SEQ ID NO: 181 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERAAKDFVQWLMNT

SEQ ID NO: 182 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDKRAAEDFVQWLMNT

SEQ ID NO: 183 - protein, 29 aa, Artificial Sequence
  glucagon analog
  MISC_FEATURE: c-term amidation
  MOD_RES (2)..(2): Aminoisobutyric acid
HXEGTFTSDYSKYLDEQAAKEFIAWLMNT

SEQ ID NO: 184 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDEQAAKEFIAWLMNT

SEQ ID NO: 185 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDEQAAKEFIAWLMNT

SEQ ID NO: 186 - protein, 29 aa, Artificial Sequence
  glucagon analog
  MISC_FEATURE: c-term amidation
  MOD_RES (2)..(2): Aminoisobutyric acid
HXEGTFTSDYSKYLDEQAAKEFIAWLVKG

SEQ ID NO: 187 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDEQAAKEFIAWLVKG

SEQ ID NO: 188 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDEQAAKEFIAWLVKG

SEQ ID NO: 189 - protein, 29 aa, Artificial Sequence
  glucagon analog
  MISC_FEATURE: c-term amidation
  MOD_RES (2)..(2): D-Ala
HXEGTFTSDYSKYLDERRAQDFVQWLMNT

SEQ ID NO: 190 - protein, 29 aa, Artificial Sequence
  glucagon analog
  MISC_FEATURE: c-term amidation
  MOD_RES (2)..(2): D-Ala
HXEGTFTSDYSKYLDERRAKDFVQWLMNT

SEQ ID NO: 191 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERRAKDFVQWLMNT

SEQ ID NO: 192 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAQDFVQWLMNT

SEQ ID NO: 193 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAKDFVQWLMNT

SEQ ID NO: 194 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRRAEDFVQWLMNT

SEQ ID NO: 195 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERAAKDFVQWLMNT

SEQ ID NO: 196 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERAAKDFVQWLMNT

SEQ ID NO: 197 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAQDFVQWLMNT

SEQ ID NO: 198 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAKDFVQWLMNT

SEQ ID NO: 199 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRAAEDFVQWLMNT

SEQ ID NO: 200 - protein, 29 aa, Artificial Sequence
  glucagon analog
  MISC_FEATURE: c-term amidation
  MOD_RES (2)..(2): D-Ala
HXEGTFTSDYSKYLDEQAAKEFIAWLMNT

SEQ ID NO: 201 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDEQAAKEFIAWLMNT

SEQ ID NO: 202 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDEQAAKEFIAWLMNT

SEQ ID NO: 203 - protein, 29 aa, Artificial Sequence
  glucagon analog
  MISC_FEATURE: c-term amidation
  MOD_RES (2)..(2): D-Ala
HXEGTFTSDYSKYLDEQAAKEFIAWLVKG

SEQ ID NO: 204 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDEQAAKEFIAWLVKG

SEQ ID NO: 205 - protein, 29 aa, Artificial Sequence
  glucagon analog
  MISC_FEATURE: Lactam ring between side chains at positions 16 and 20
  MOD_RES (2)..(2): D-Ala
  MISC_FEATURE (16)..(20): c-term amidation
HXEGTFTSDYSKYLDEQAAKEFIAWLVKG

SEQ ID NO: 206 - protein, 29 aa, Artificial Sequence
  glucagon analog
  MISC_FEATURE: c-term amidation
  MOD_RES (24)..(24): Cys-PEG
HSQGTFTSDYSKYLDERRAQDFVCWLMNT

SEQ ID NO: 207 - protein, 29 aa, Artificial Sequence
  glucagon analog
  MISC_FEATURE: c-term amidation
  MOD_RES (24)..(24): Cys-PEG
HSQGTFTSDYSKYLDERRAKDFVCWLMNT

SEQ ID NO: 208 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDERRAKDFVCWLMNT

SEQ ID NO: 209 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDERRAQDFVCWLMNT

SEQ ID NO: 210 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDERRAKDFVCWLMNT

SEQ ID NO: 211 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDKRRAEDFVCWLMNT

SEQ ID NO: 212 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDERAAKDFVCWLMNT

SEQ ID NO: 213 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDERAAKDFVCWLMNT

SEQ ID NO: 214 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDERAAQDFVCWLMNT

SEQ ID NO: 215 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDERAAKDFVCWLMNT

SEQ ID NO: 216 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDKRAAEDFVCWLMNT

SEQ ID NO: 217 - protein, 29 aa, Artificial Sequence
  glucagon analog
  MISC_FEATURE: c-term amidation
  MOD_RES (24)..(24): Cys-PEG
HSQGTFTSDYSKYLDEQAAKEFICWLMNT

SEQ ID NO: 218 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDEQAAKEFICWLMNT

SEQ ID NO: 219 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDEQAAKEFICWLMNT

SEQ ID NO: 220 - protein, 29 aa, Artificial Sequence
  glucagon analog
  MISC_FEATURE: c-term amidation
  MOD_RES (24)..(24): Cys-PEG
HSQGTFTSDYSKYLDEQAAKEFICWLVKG

SEQ ID NO: 221 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDEQAAKEFICWLVKG

SEQ ID NO: 222 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDEQAAKEFICWLVKG

SEQ ID NO: 223 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDERRAQDFVCWLMNT

SEQ ID NO: 224 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDERRAKDFVCWLMNT

SEQ ID NO: 225 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDERRAKDFVCWLMNT

SEQ ID NO: 226 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDERRAQDFVCWLMNT

SEQ ID NO: 227 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDERRAKDFVCWLMNT

SEQ ID NO: 228 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDKRRAEDFVCWLMNT

SEQ ID NO: 229 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDERAAKDFVCWLMNT

SEQ ID NO: 230 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDERAAKDFVCWLMNT

SEQ ID NO: 231 - protein, 29 aa, Artificial Sequence
  glucagon analog
  MISC_FEATURE: c-term amidation; lactam ring between side chains at positions 12 and 16
  MOD_RES (1)..(1): (Des-amino)His
  MOD_RES (24)..(24): Cys-PEG
XSQGTFTSDYSKYLDERAAQDFVCWLMNT

SEQ ID NO: 232 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDERAAKDFVCWLMNT

SEQ ID NO: 233 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDKRAAEDFVCWLMNT

SEQ ID NO: 234 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDEQAAKEFICWLMNT

SEQ ID NO: 235 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDEQAAKEFICWLMNT

SEQ ID NO: 236 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDEQAAKEFICWLMNT

SEQ ID NO: 237 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDEQAAKEFICWLVKG

SEQ ID NO: 238 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDEQAAKEFICWLVKG

SEQ ID NO: 239 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDEQAAKEFICWLVKG

SEQ ID NO: 240 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAQDFVCWLMNT

SEQ ID NO: 241 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVCWLMNT

SEQ ID NO: 242 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 243 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDERRAQDFVCWLMNT

SEQ ID NO: 244 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDERRAKDFVCWLMNT

SEQ ID NO: 245 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring side chains at positions 16 and 20
  MOD_RES (24)..(24): Cys-PEG
HXQGTFTSDYSKYLDKRRAEDFVCWLMNT

SEQ ID NO: 246 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVCWLMNT

SEQ ID NO: 247 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERAAKDFVCWLMNT

SEQ ID NO: 248 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDERAAQDFVCWLMNT

SEQ ID NO: 249 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDERAAKDFVCWLMNT

SEQ ID NO: 250 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDKRAAEDFVCWLMNT

SEQ ID NO: 251 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLMNT

SEQ ID NO: 252 - protein, 29 aa, Artificial Sequence
  Synthetic peptide
  misc_feature (2)..(2): Xaa can be any naturally occurring amino acid
HXQGTFTSDYSKYLDEQAAKEFICWLMNT

SEQ ID NO: 253 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDEQAAKEFICWLMNT

SEQ ID NO: 254 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLVKG

SEQ ID NO: 255 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDEQAAKEFICWLVKG

SEQ ID NO: 256 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDEQAAKEFICWLVKG

SEQ ID NO: 257 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDERRAQDFVCWLMNT

SEQ ID NO: 258 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDERRAKDFVCWLMNT

SEQ ID NO: 259 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 260 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chrains at positions 12 and 16
  MOD_RES (24)..(24): Cys-PEG
HXQGTFTSDYSKYLDERRAQDFVCWLMNT

SEQ ID NO: 261 - protein, 29 aa, Artificial Sequence
  Synthetic peptide
  MISC_FEATURE: c-term amidation; lactam ring between side chains at positions 12 and 16
  MOD_RES (2)..(2): D-Ala
  MOD_RES (24)..(24): Cys-PEG
HXQGTFTSDYSKYLDERRAKDFVCWLMNT

SEQ ID NO: 262 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDKRRAEDFVCWLMNT

SEQ ID NO: 263 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDERAAKDFVCWLMNT

SEQ ID NO: 264 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDERAAKDFVCWLMNT

SEQ ID NO: 265 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXQGTFTSDYSKYLDERAAQDFVCWLMNT

SEQ ID NO: 266 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring betwee side chains at positions 12 and 16
  MOD_RES (24)..(24): Cys-PEG
HXQGTFTSDYSKYLDERAAKDFVCWLMNT

SEQ ID NO: 267 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDKRAAEDFVCWLMNT

SEQ ID NO: 268 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDEQAAKEFICWLMNT

SEQ ID NO: 269 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring betwee side chains at positions 12 and 16
  MOD_RES (24)..(24): Cys-PEG
HXQGTFTSDYSKYLDEQAAKEFICWLMNT

SEQ ID NO: 270 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring betwee side chains at positions 16 and 20
  MOD_RES (24)..(24): Cys-PEG
HXQGTFTSDYSKYLDEQAAKEFICWLMNT

SEQ ID NO: 271 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDEQAAKEFICWLVKG

SEQ ID NO: 272 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXQGTFTSDYSKYLDEQAAKEFICWLVKG

SEQ ID NO: 273 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDEQAAKEFICWLVKG

SEQ ID NO: 274 - protein, 29 aa, Artificial Sequence
  Synthetic peptide
  MISC_FEATURE: c-term amidation
  MOD_RES (24)..(24): Cys-PEG
HSEGTFTSDYSKYLDERRAQDFVCWLMNT

SEQ ID NO: 275 - protein, 29 aa, Artificial Sequence
  Synthetic peptide
  MISC_FEATURE: c-term amidation
  MOD_RES (24)..(24): Cys-PEG
HSEGTFTSDYSKYLDERRAKDFVCWLMNT

SEQ ID NO: 276 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDERRAKDFVCWLMNT

SEQ ID NO: 277 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDERRAQDFVCWLMNT

SEQ ID NO: 278 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDERRAKDFVCWLMNT

SEQ ID NO: 279 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDKRRAEDFVCWLMNT

SEQ ID NO: 280 - protein, 29 aa, Artificial Sequence
  Synthetic peptide
  MISC_FEATURE: c-term amidation
  MOD_RES (24)..(24): Cys-PEG
HSEGTFTSDYSKYLDERAAKDFVCWLMNT

SEQ ID NO: 281 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDERAAKDFVCWLMNT

SEQ ID NO: 282 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDERAAQDFVCWLMNT

SEQ ID NO: 283 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDERAAKDFVCWLMNT

SEQ ID NO: 284 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDKRAAEDFVCWLMNT

SEQ ID NO: 285 - protein, 29 aa, Artificial Sequence
  Synthetic peptide
  MISC_FEATURE: c-term amidation
  MOD_RES (24)..(24): Cys-PEG
HSEGTFTSDYSKYLDEQAAKEFICWLMNT

SEQ ID NO: 286 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDEQAAKEFICWLMNT

SEQ ID NO: 287 - protein, 29 aa, Artificial Sequence
  Synthetic peptide
  MISC_FEATURE: c-term amidation
  MISC_FEATURE (16)..(20): Lactam ring between side chain at positions 16 and 20
  MOD_RES (24)..(24): Cys-PEG
HSEGTFTSDYSKYLDEQAAKEFICWLMNT

SEQ ID NO: 288 - protein, 29 aa, Artificial Sequence
  Synthetic peptide
  MISC_FEATURE: c-term amidation
  MOD_RES (24)..(24): Cys-PEG
HSEGTFTSDYSKYLDEQAAKEFICWLVKG

SEQ ID NO: 289 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDEQAAKEFICWLVKG

SEQ ID NO: 290 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDEQAAKEFICWLVKG

SEQ ID NO: 291 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDERRAQDFVCWLMNT

SEQ ID NO: 292 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDERRAKDFVCWLMNT

SEQ ID NO: 293 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDERRAKDFVCWLMNT

SEQ ID NO: 294 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDERRAQDFVCWLMNT

SEQ ID NO: 295 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDERRAKDFVCWLMNT

SEQ ID NO: 296 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDKRRAEDFVCWLMNT

SEQ ID NO: 297 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDERAAKDFVCWLMNT

SEQ ID NO: 298 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDERAAKDFVCWLMNT

SEQ ID NO: 299 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDERAAQDFVCWLMNT

SEQ ID NO: 300 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDERAAKDFVCWLMNT

SEQ ID NO: 301 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDKRAAEDFVCWLMNT

SEQ ID NO: 302 - protein, 29 aa, Artificial Sequencce
  Synthetic peptide
  MISC_FEATURE: c-term amidation
  MOD_RES (1)..(1): (Des-amino)His
  MOD_RES (24)..(24): Cys-PEG
XSEGTFTSDYSKYLDEQAAKGFICWLMNT

SEQ ID NO: 303 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDEQAAKGFICWLMNT

SEQ ID NO: 304 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDEQAAKGFICWLMNT

SEQ ID NO: 305 - protein, 29 aa, Artificial Sequencce
  Synthetic peptide
  MISC_FEATURE: c-term amidation
  MOD_RES (1)..(1): (des-amino)His
  MOD_RES (24)..(24): Cys-PEG
XSEGTFTSDYSKYLDEQAAKGFICWLVKG

SEQ ID NO: 306 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDEQAAKGFICWLVKG

SEQ ID NO: 307 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDEQAAKGFICWLVKG

SEQ ID NO: 308 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERRAQDFVCWLMNT

SEQ ID NO: 309 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERRAKDFVCWLMNT

SEQ ID NO: 310 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXEGTFTSDYSKYLDERRAKDFVCWLMNT

SEQ ID NO: 311 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chain at positions 12 and 16
  MOD_RES (24)..(24): Cys-PEG
HXEGTFTSDYSKYLDERRAQDFVCWLMNT

SEQ ID NO: 312 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDERRAKDFVCWLMNT

SEQ ID NO: 313 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXEGTFTSDYSKYLDKRRAEDFVCWLMNT

SEQ ID NO: 314 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERAAKDFVCWLMNT

SEQ ID NO: 315 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between seide chains at positions 16 and 20
  MOD_RES (24)..(24): Cys-PEG
HXEGTFTSDYSKYLDERAAKDFVCWLMNT

SEQ ID NO: 316 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDERAAQDFVCWLMNT

SEQ ID NO: 317 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 adn 16
  MOD_RES (24)..(24): Cys-PEG
HXEGTFTSDYSKYLDERAAKDFVCWLMNT

SEQ ID NO: 318 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXEGTFTSDYSKYLDKRAAEDFVCWLMNT

SEQ ID NO: 319 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDEQAAKEFICWLMNT

SEQ ID NO: 320 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDEQAAKEFICWLMNT

SEQ ID NO: 321 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at position 16 and 20
  MOD_RES (24)..(24): Cys-PEG
HXEGTFTSDYSKYLDEQAAKEFICWLMNT

SEQ ID NO: 322 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDEQAAKEFICWLVKG

SEQ ID NO: 323 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDEQAAKEFICWLVKG

SEQ ID NO: 324 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at position 16 and 20
  MOD_RES (24)..(24): Cys-PEG
HXEGTFTSDYSKYLDEQAAKEFICWLVKG

SEQ ID NO: 325 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERRAQDFVCWLMNT

SEQ ID NO: 326 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERRAKDFVCWLMNT

SEQ ID NO: 327 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDERRAKDFVCWLMNT

SEQ ID NO: 328 - protein, 29 aa, Artificial Sequence
  Synthetic peptide
  MISC_FEATURE: c-term amidation
  MOD_RES (2)..(2): D-Ala
  MISC_FEATURE (12)..(16): Lactam between side chains at positions 12 and 16
  MOD_RES (24)..(24): Cys-PEG
HXEGTFTSDYSKYLDERRAQDFVCWLMNT

SEQ ID NO: 329 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDERRAKDFVCWLMNT

SEQ ID NO: 330 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDKRRAEDFVCWLMNT

SEQ ID NO: 331 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERAAKDFVCWLMNT

SEQ ID NO: 332 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDERAAKDFVCWLMNT

SEQ ID NO: 333 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDERAAQDFVCWLMNT

SEQ ID NO: 334 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDERAAKDFVCWLMNT

SEQ ID NO: 335 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chainst at positions 16 and 20
  MOD_RES (24)..(24): Cys-PEG
HXEGTFTSDYSKYLDKRAAEDFVCWLMNT

SEQ ID NO: 336 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDEQAAKEFICWLMNT

SEQ ID NO: 337 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDEQAAKEFICWLMNT

SEQ ID NO: 338 - protein, 29 aa, Artificial Sequence
  Synthetic peptide
  MISC_FEATURE: c-term amidation
  MOD_RES (2)..(2): D-Ala
  MISC_FEATURE (16)..(20): Lactam right between side chains at positions 16 and 20
  MOD_RES (24)..(24): Cys-PEG
HXEGTFTSDYSKYLDEQAAKEFICWLMNT

SEQ ID NO: 339 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDEQAAKEFICWLVKG

SEQ ID NO: 340 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDEQAAKEFICWLVKG

SEQ ID NO: 341 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDEQAAKEFICWLVKG

SEQ ID NO: 342 - protein, 29 aa, Artificial Sequence
  Synthetic peptide
  MISC_FEATURE: c-term amidation
  MOD_RES (16)..(16): Cys-PEG
HSQGTFTSDYSKYLDCRRAKDFVQWLMNT

SEQ ID NO: 343 - protein, 29 aa, Artificial Sequence
  Synthetic peptide
  MISC_FEATURE: c-term amidation
  MOD_RES (16)..(16): Cys-PEG
HSQGTFTSDYSKYLDCRAAKDFVQWLMNT

SEQ ID NO: 344 - protein, 29 aa, Artificial Sequence
  Synthetic peptide
  MISC_FEATURE: c-term amidation
  MOD_RES (16)..(16): Cys-PEG
HSQGTFTSDYSKYLDCQAAKEFIAWLMNT

SEQ ID NO: 345 - protein, 29 aa, Artificial Sequence
  Synthetic peptide
  MISC_FEATURE: c-term amidation
  MOD_RES (16)..(16): Cys-PEG
HSQGTFTSDYSKYLDCQAAKEFIAWLVKG

SEQ ID NO: 346 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCRRAKDFVQWLMNT

SEQ ID NO: 347 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCRAAKDFVQWLMNT

SEQ ID NO: 348 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLMNT

SEQ ID NO: 349 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLVKG

SEQ ID NO: 350 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLMNT

SEQ ID NO: 351 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCRAAKDFVQWLMNT

SEQ ID NO: 352 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCQAAKEFIAWLMNT

SEQ ID NO: 353 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCQAAKEFIAWLVKG

SEQ ID NO: 354 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCRRAKDFVQWLMNT

SEQ ID NO: 355 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCRAAKDFVQWLMNT

SEQ ID NO: 356 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCQAAKEFIAWLMNT

SEQ ID NO: 357 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCQAAKEFIAWLVKG

SEQ ID NO: 358 - protein, 29 aa, Artificial Sequence
  Synthetic peptide
  MISC_FEATURE: c-term amidation
  MOD_RES (16)..(16): Cys-PEG
HSEGTFTSDYSKYLDCRRAKDFVQWLMNT

SEQ ID NO: 359 - protein, 29 aa, Artificial Sequence
  Synthetic peptide
  MISC_FEATURE: c-term amidation
  MOD_RES (16)..(16): Cys-PEG
HSEGTFTSDYSKYLDCRAAKDFVQWLMNT

SEQ ID NO: 360 - protein, 29 aa, Artificial Sequence
  Synthetic peptide
  MISC_FEATURE: c-term amidation
  MOD_RES (16)..(16): Cys-PEG
HSEGTFTSDYSKYLDCQAAKEFIAWLMNT

SEQ ID NO: 361 - protein, 29 aa, Artificial Sequence
  Synthetic peptide
  MISC_FEATURE: c-term amidation
  MOD_RES (16)..(16): Cys-PEG
HSEGTFTSDYSKYLDCQAAKEFIAWLVKG

SEQ ID NO: 362 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCRRAKDFVQWLMNT

SEQ ID NO: 363 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCRAAKDFVQWLMNT

SEQ ID NO: 364 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCQAAKEFIAWLMNT

SEQ ID NO: 365 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCQAAKEFIAWLVKG

SEQ ID NO: 366 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRRAKDFVQWLMNT

SEQ ID NO: 367 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRAAKDFVQWLMNT

SEQ ID NO: 368 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLMNT

SEQ ID NO: 369 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLVKG

SEQ ID NO: 370 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRRAKDFVQWLMNT

SEQ ID NO: 371 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRAAKDFVQWLMNT

SEQ ID NO: 372 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLMNT

SEQ ID NO: 373 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLVKG

SEQ ID NO: 374 - protein, 29 aa, Artificial Sequence
  Synthetic peptide
  MISC_FEATURE: c-term amidation
HSQGTFTSDYSKYLDERRAQDFVQWLMDT

SEQ ID NO: 375 - protein, 29 aa, Artificial Sequence
  Synthetic peptide
  MISC_FEATURE: c-term amidation
HSQGTFTSDYSKYLDERRAKDFVQWLMDT

SEQ ID NO: 376 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDERRAKDFVQWLMDT

SEQ ID NO: 377 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERRAQDFVQWLMDT

SEQ ID NO: 378 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERRAKDFVQWLMDT

SEQ ID NO: 379 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDKRRAEDFVQWLMDT

SEQ ID NO: 380 - protein, 29 aa, Artificial Sequence
  Synthetic peptide
  MISC_FEATURE: c-term amidation
HSQGTFTSDYSKYLDERAAKDFVQWLMDT

SEQ ID NO: 381 - protein, 29 aa, Artificial Sequence
  Synthetic peptide
  MISC_FEATURE: c-term amidation; lactam ring between side chains at positions 16 and 20
HSQGTFTSDYSKYLDERAAKDFVQWLMDT

SEQ ID NO: 382 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERAAQDFVQWLMDT

SEQ ID NO: 383 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERAAKDFVQWLMDT

SEQ ID NO: 384 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDKRAAEDFVQWLMDT

SEQ ID NO: 385 - protein, 29 aa, Artificial Sequence
  Synthetic peptide
  MISC_FEATURE: c-term amidation
HSQGTFTSDYSKYLDEQAAKEFIAWLMDT

SEQ ID NO: 386 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDEQAAKEFIAWLMDT

SEQ ID NO: 387 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDEQAAKEFIAWLMDT

SEQ ID NO: 388 - protein, 29 aa, Artificial Sequence
  Synthetic peptide
  MISC_FEATURE: c-term amidation
  MOD_RES (1)..(1): (Des-amino)His
XSQGTFTSDYSKYLDERRAQDFVQWLMDT

SEQ ID NO: 389 - protein, 29 aa, Artificial Sequence
  Synthetic peptide
  MISC_FEATURE: c-term amidation
  MOD_RES (1)..(1): (Des-amino)His
XSQGTFTSDYSKYLDERRAKDFVQWLMDT

SEQ ID NO: 390 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERRAKDFVQWLMDT

SEQ ID NO: 391 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERRAQDFVQWLMDT

SEQ ID NO: 392 - protein, 29 aa, Artificial Sequence
  Synthetic peptide
  misc_feature (1)..(1): Xaa can be any naturally occurring amino acid
XSQGTFTSDYSKYLDERRAKDFVQWLMDT

SEQ ID NO: 393 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRRAEDFVQWLMDT

SEQ ID NO: 394 - protein, 29 aa, Artificial Sequence
  Synthetic peptide
  MISC_FEATURE: c-term amidation
  MOD_RES (1)..(1): (Des-amino)His
XSQGTFTSDYSKYLDERAAKDFVQWLMDT

SEQ ID NO: 395 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERAAKDFVQWLMDT

SEQ ID NO: 396 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAQDFVQWLMDT

SEQ ID NO: 397 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAKDFVQWLMDT

SEQ ID NO: 398 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRAAEDFVQWLMDT

SEQ ID NO: 399 - protein, 29 aa, Artificial Sequence
  Synthetic peptide
  MISC_FEATURE: c-term amidation
  MOD_RES (1)..(1): (Des-amino)His
XSQGTFTSDYSKYLDEQAAKEFIAWLMDT

SEQ ID NO: 400 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLMDT

SEQ ID NO: 401 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDEQAAKEFIAWLMDT

SEQ ID NO: 402 - protein, 29 aa, Artificial Sequence
  Synthetic peptide
  MISC_FEATURE: c-term amidation
  MOD_RES (2)..(2): Aminoisobutyric acid
HXQGTFTSDYSKYLDERRAQDFVQWLMDT

SEQ ID NO: 403 - protein, 29 aa, Artificial Sequence
  Synthetic peptide
  MISC_FEATURE: c-term amidation
  MOD_RES (2)..(2): Aminoisobutyric acid
HXQGTFTSDYSKYLDERRAKDFVQWLMDT

SEQ ID NO: 404 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERRAKDFVQWLMDT

SEQ ID NO: 405 - protein, 29 aa, Artificial Sequence
  Synthetic peptide
  MISC_FEATURE: c-term amidation
  MOD_RES (2)..(2): aminoisobutyric acid
  MISC_FEATURE (12)..(16): Lactam ring between side chains at positions 12 and 16
HXQGTFTSDYSKYLDERRAQDFVQWLMDT

SEQ ID NO: 406 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERRAKDFVQWLMDT

SEQ ID NO: 407 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDKRRAEDFVQWLMDT

SEQ ID NO: 408 - protein, 29 aa, Artificial Sequence
  Synthetic peptide
  MOD_RES (2)..(2): Aminoisobutyric acid
  MISC_FEATURE (2)..(2): c-term amidation
HXQGTFTSDYSKYLDERAAKDFVQWLMDT

SEQ ID NO: 409 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERAAKDFVQWLMDT

SEQ ID NO: 410 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERAAQDFVQWLMDT

SEQ ID NO: 411 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERAAKDFVQWLMDT

SEQ ID NO: 412 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 16 and 20
HXQGTFTSDYSKYLDKRAAEDFVQWLMDT

SEQ ID NO: 413 - protein, 29 aa, Artificial Sequence
  Synthetic peptide
  MISC_FEATURE: c-term amidation
  MOD_RES (2)..(2): Aminoisobutyric acid
HXQGTFTSDYSKYLDEQAAKEFIAWLMDT

SEQ ID NO: 414 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDEQAAKEFIAWLMDT

SEQ ID NO: 415 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDEQAAKEFIAWLMDT

SEQ ID NO: 416 - protein, 29 aa, Artificial Sequence
  Synthetic peptide
  MISC_FEATURE: c-term amidation
  MOD_RES (2)..(2): D-Ala
HXQGTFTSDYSKYLDERRAQDFVQWLMDT

SEQ ID NO: 417 - protein, 29 aa, Artificial Sequence
  Synthetic peptide
  MISC_FEATURE: c-term amidation
  MOD_RES (2)..(2): D-Ala
HXQGTFTSDYSKYLDERRAKDFVQWLMDT

SEQ ID NO: 418 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERRAKDFVQWLMDT

SEQ ID NO: 419 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAQDFVQWLMDT

SEQ ID NO: 420 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAKDFVQWLMDT

SEQ ID NO: 421 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRRAEDFVQWLMDT

SEQ ID NO: 422 - protein, 29 aa, Artificial Sequence
  Synthetic peptide
  MISC_FEATURE: c-term amidation
  MOD_RES (2)..(2): D-Ala
HXQGTFTSDYSKYLDERAAKDFVQWLMDT

SEQ ID NO: 423 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERAAKDFVQWLMDT

SEQ ID NO: 424 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAQDFVQWLMDT

SEQ ID NO: 425 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAKDFVQWLMDT

SEQ ID NO: 426 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRAAEDFVQWLMDT

SEQ ID NO: 427 - protein, 29 aa, Artificial Sequence
  Synthetic peptide
  MISC_FEATURE: c-term amidation
  MOD_RES (2)..(2): D-Ala
HXQGTFTSDYSKYLDEQAAKEFIAWLMDT

SEQ ID NO: 428 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDEQAAKEFIAWLMDT

SEQ ID NO: 429 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDEQAAKEFIAWLMDT

SEQ ID NO: 430 - protein, 29 aa, Artificial Sequence
  Synthetic peptide
  MISC_FEATURE: c-term amidation
HSEGTFTSDYSKYLDERRAQDFVQWLMDT

SEQ ID NO: 431 - protein, 29 aa, Artificial Sequence
  Synthetic peptide
  MISC_FEATURE: c-term amidation
HSEGTFTSDYSKYLDERRAKDFVQWLMDT

SEQ ID NO: 432 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDERRAKDFVQWLMDT

SEQ ID NO: 433 - protein, 29 aa, Artificial Sequence
  Synthetic peptide
  MISC_FEATURE: c-term amidation
  MISC_FEATURE (16)..(16): Lactam ring between side chains at positions 12 and 16
HSEGTFTSDYSKYLDERRAQDFVQWLMDT

SEQ ID NO: 434 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDERRAKDFVQWLMDT

SEQ ID NO: 435 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDKRRAEDFVQWLMDT

SEQ ID NO: 436 - protein, 29 aa, Artificial Sequence
  Synthetic peptide
  MISC_FEATURE: c-term amidation
HSEGTFTSDYSKYLDERAAKDFVQWLMDT

SEQ ID NO: 437 - protein, 29 aa, Artificial Sequence
  Synthetic peptide
  MISC_FEATURE: c-term amidation
  MISC_FEATURE: Lactam ring between side chains at positions 16 and 20
HSEGTFTSDYSKYLDERAAKDFVQWLMDT

SEQ ID NO: 438 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDERAAQDFVQWLMDT

SEQ ID NO: 439 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDERAAKDFVQWLMDT

SEQ ID NO: 440 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDKRAAEDFVQWLMDT

SEQ ID NO: 441 - protein, 29 aa, Artificial Sequence
  Synthetic peptide
  MISC_FEATURE: c-term amidation
HSEGTFTSDYSKYLDEQAAKEFIAWLMDT

SEQ ID NO: 442 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDEQAAKEFIAWLMDT

SEQ ID NO: 443 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDEQAAKEFIAWLMDT

SEQ ID NO: 444 - protein, 29 aa, Artificial Sequence
  Synthetic peptide
  MISC_FEATURE: c-term amidation
  MOD_RES (1)..(1): (Des-amino)His
XSEGTFTSDYSKYLDERRAQDFVQWLMDT

SEQ ID NO: 445 - protein, 29 aa, Artificial Sequence
  Synthetic peptide
  MISC_FEATURE: c-term amidation
  MOD_RES (1)..(1): (Des-amino)His
XSEGTFTSDYSKYLDERRAKDFVQWLMDT

SEQ ID NO: 446 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERRAKDFVQWLMDT

SEQ ID NO: 447 - protein, 29 aa, Artificial Sequence
  Synthetic peptide
  MISC_FEATURE: c-term amidation
  MISC_FEATURE: Lactam ring between side chains at positions 12 and 16
  MOD_RES (1)..(1): (Des-amino)His
XSEGTFTSDYSKYLDERRAQDFVQWLMDT

SEQ ID NO: 448 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERRAKDFVQWLMDT

SEQ ID NO: 449 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRRAEDFVQWLMDT

SEQ ID NO: 450 - protein, 29 aa, Artificial Sequence
  Synthetic peptide
  MISC_FEATURE: c-term amidation
  MOD_RES (1)..(1): (Des-amino)His
XSEGTFTSDYSKYLDERAAKDFVQWLMDT

SEQ ID NO: 451 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERAAKDFVQWLMDT

SEQ ID NO: 452 - protein, 29 aa, Artificial Sequence
  Synthetic peptide
  MISC_FEATURE: C-term amidation
  MOD_RES (1)..(1): (Des-amino)His
  MISC_FEATURE (12)..(16): Lactam ring between side chains at positions 12 and 16
XSEGTFTSDYSKYLDERAAQDFVQWLMDT

SEQ ID NO: 453 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERAAKDFVQWLMDT

SEQ ID NO: 454 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRAAEDFVQWLMDT

SEQ ID NO: 455 - protein, 29 aa, Artificial Sequence
  Synthetic peptide
  MISC_FEATURE: c-term amidation
  MOD_RES (1)..(1): (Des-amino)His
XSEGTFTSDYSKYLDEQAAKEFIAWLMDT

SEQ ID NO: 456 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDEQAAKEFIAWLMDT

SEQ ID NO: 457 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDEQAAKEFIAWLMDT

SEQ ID NO: 458 - protein, 29 aa, Artificial Sequence
  Synthetic peptide
  MISC_FEATURE: c-term amidation
  MOD_RES (2)..(2): Aminoisobutyric acid
HXEGTFTSDYSKYLDERRAQDFVQWLMDT

SEQ ID NO: 459 - protein, 29 aa, Artificial Sequence
  Synthetic peptide
  MISC_FEATURE: c-term amidation
  MOD_RES (2)..(2): Aminoisobutyric acid
HXEGTFTSDYSKYLDERRAKDFVQWLMDT

SEQ ID NO: 460 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERRAKDFVQWLMDT

SEQ ID NO: 461 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAQDFVQWLMDT

SEQ ID NO: 462 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAKDFVQWLMDT

SEQ ID NO: 463 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDKRRAEDFVQWLMDT

SEQ ID NO: 464 - protein, 29 aa, Artificial Sequence
  Synthetic peptide
  MISC_FEATURE: c-term amidation
  MOD_RES (2)..(2): Aminoisobutyric acid
HXEGTFTSDYSKYLDERAAKDFVQWLMDT

SEQ ID NO: 465 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERAAKDFVQWLMDT

SEQ ID NO: 466 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at postions 12 and 16
HXEGTFTSDYSKYLDERAAQDFVQWLMDT

SEQ ID NO: 467 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERAAKDFVQWLMDT

SEQ ID NO: 468 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 16 and 20
HXEGTFTSDYSKYLDKRAAEDFVQWLMDT

SEQ ID NO: 469 - protein, 29 aa, Artificial Sequence
  Synthetic peptide
  MISC_FEATURE: c-term amidation
  MOD_RES (2)..(2): Aminoisobutyric acid
HXEGTFTSDYSKYLDEQAAKEFIAWLMDT

SEQ ID NO: 470 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDEQAAKEFIAWLMDT

SEQ ID NO: 471 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDEQAAKEFIAWLMDT

SEQ ID NO: 472 - protein, 29 aa, Artificial Sequence
  Synthetic peptide
  MISC_FEATURE: c-term amidation
  MOD_RES (2)..(2): D-Ala
HXEGTFTSDYSKYLDERRAQDFVQWLMDT

SEQ ID NO: 473 - protein, 29 aa, Artificial Sequence
  Synthetic peptide
  MISC_FEATURE: c-term amidation
  MOD_RES (2)..(2): D-Ala
HXEGTFTSDYSKYLDERRAKDFVQWLMDT

SEQ ID NO: 474 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERRAKDFVQWLMDT

SEQ ID NO: 475 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAQDFVQWLMDT

SEQ ID NO: 476 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAKDFVQWLMDT

SEQ ID NO: 477 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRRAEDFVQWLMDT

SEQ ID NO: 478 - protein, 29 aa, Artificial Sequence
  Synthetic peptide
  MISC_FEATURE: c-term amidation
  MOD_RES (2)..(2): D-Ala
HXEGTFTSDYSKYLDERAAKDFVQWLMDT

SEQ ID NO: 479 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERAAKDFVQWLMDT

SEQ ID NO: 480 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAQDFVQWLMDT

SEQ ID NO: 481 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAKDFVQWLMDT

SEQ ID NO: 482 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRAAEDFVQWLMDT

SEQ ID NO: 483 - protein, 29 aa, Artificial Sequence
  Synthetic peptide
  MISC_FEATURE: c-term amidation
  MOD_RES (2)..(2): D-Ala
HXEGTFTSDYSKYLDEQAAKEFIAWLMDT

SEQ ID NO: 484 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDEQAAKEFIAWLMDT

SEQ ID NO: 485 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDEQAAKEFIAWLMDT

SEQ ID NO: 486 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLMNT

SEQ ID NO: 487 - protein, 29 aa, Artificial Sequence
  Synthetic peptide
  MISC_FEATURE: c-term amidation
  MOD_RES (2)..(2): Aminoisobutyric acid
  MOD_RES (29)..(29): Cys-PEG
HXQGTFTSDYSKYLDEQAAKEFIAWLMNC

SEQ ID NO: 488 - protein, 40 aa, Artificial Sequence
  Synthetic peptide
  MISC_FEATURE: c-term amidation
  MOD_RES (2)..(2): Aminoisobutyric acid
  MOD_RES (40)..(40): Cys-PEG
HXQGTFTSDYSKYLDEQAAKEFIAWLMNGGPSSGAPPPSC

SEQ ID NO: 489 - protein, 40 aa, Artificial Sequence; identical to SEQ ID NO: 488
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (40)..(40): Cys-PEG

SEQ ID NO: 490 - protein, 39 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLMNGGPSSGAPPPS

SEQ ID NO: 491 - protein, 39 aa, Artificial Sequence; identical to SEQ ID NO: 490
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG

SEQ ID NO: 492 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVCWLMNT

SEQ ID NO: 493 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVQWLMNC

SEQ ID NO: 494 - protein, 40 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVQWLMNGGPSSGAPPPSC

SEQ ID NO: 495 - protein, 40 aa, Artificial Sequence; identical to SEQ ID NO: 494
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (40)..(40): Cys-PEG

SEQ ID NO: 496 - protein, 39 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVCWLMNGGPSSGAPPPS

SEQ ID NO: 497 - protein, 39 aa, Artificial Sequence; identical to SEQ ID NO: 496
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG

SEQ ID NO: 498 - protein, 30 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVCWLMNTA

SEQ ID NO: 499 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVQWLMNC

SEQ ID NO: 500 - protein, 40 aa, Artificial Sequence
  Synthetic peptide
  MISC_FEATURE: c-term amidation
  MOD_RES (2)..(2): Aminoisobutyric acid
  MOD_RES (40)..(40): Cys-PEG
HXQGTFTSDYSKYLDERRAKDFVQWLMNGGPSSGAPPPSC

SEQ ID NO: 501 - protein, 40 aa, Artificial Sequence; identical to SEQ ID NO: 500
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (40)..(40): Cys-PEG

SEQ ID NO: 502 - protein, 39 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVCWLMNGGPSSGAPPPS

SEQ ID NO: 503 - protein, 39 aa, Artificial Sequence; identical to SEQ ID NO: 502
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG

SEQ ID NO: 504 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDEQAAKEFICWLMNT

SEQ ID NO: 505 - protein, 29 aa, Artificial Sequence
  Synthetic peptide
  MISC_FEATURE: c-term amidation
  MOD_RES (1)..(1): Alpha, Alpha-Dimethyl Imidiazole Acetic Acid
  MISC_FEATURE (16)..(20): Lactam ring between side chains at positions 16 and 20
  MOD_RES (24)..(24): Cys-PEG
XSQGTFTSDYSKYLDEQAAKEFICWLMNT

SEQ ID NO: 506 - protein, 29 aa, Artificial Sequence
  Synthetic peptide
  MISC_FEATURE: c-term amidation
  MOD_RES (1)..(1): Alpha, Alpha-Dimethly Imidiazole Acetic Acid
  MOD_RES (1)..(1): Alpha, Alpha-Dimethly Imidiazole Acetic Acid
  MISC_FEATURE (16)..(20): Lactam ring between side chains at positions 16 and 20
  MOD_RES (29)..(29): Cys-PEG
XSQGTFTSDYSKYLDEQAAKEFIAWLMNC

SEQ ID NO: 507 - protein, 40 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (40)..(40): Cys-PEG
XSQGTFTSDYSKYLDEQAAKEFIAWLMNGGPSSGAPPPSC

SEQ ID NO: 508 - protein, 40 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (40)..(40): Cys-PEG
XSQGTFTSDYSKYLDERRAKDFVQWLMNGGPSSGAPPPSC

SEQ ID NO: 509 - protein, 39 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (24)..(24): Cys-PEG
XSQGTFTSDYSKYLDEQAAKEFICWLMNGGPSSGAPPPS

SEQ ID NO: 510 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  misc_feature (2)..(2): Xaa can be any naturally occurring amino acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 511 - protein, 29 aa, Artificial Sequence
  Synthetic peptide
  MISC_FEATURE: c-term amidation
  MOD_RES (2)..(2): Alpha, Alpha Dimethyl Imidiazole Acetic Acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 512 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (29)..(29): Cys-PEG
XSQGTFTSDYSKYLDERRAKDFVQWLMNC

SEQ ID NO: 513 - protein, 39 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (24)..(24): Cys-PEG
XSQGTFTSDYSKYLDERRAKDFVCWLMNGGPSSGAPPPS

SEQ ID NO: 514 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDEQAAKEFICWLMNT

SEQ ID NO: 515 - protein, 11 aa, Artificial Sequence
  Synthetic peptide
GGPSSGAPPPS

SEQ ID NO: 516 - protein, 12 aa, Artificial Sequence
  Synthetic peptide
  MOD_RES (12)..(12): Cys-PEG
GGPSSGAPPPSC

SEQ ID NO: 517 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 518 - protein, 29 aa, Artificial Sequence
  Synthetic peptide
  MISC_FEATURE: c-term amidation
  MOD_RES (24)..(24): Cys-PEG
HSQGTFTSDYSKYLDEQAAKEFICWLMNT

SEQ ID NO: 519 - protein, 29 aa, Artificial Sequence
  Synthetic peptide
  MISC_FEATURE: c-term amidation
  MOD_RES (1)..(1): Alpha, Alpha Dimethly Imidiazole Acetic Acid
  MOD_RES (24)..(24): Cys-PEG
XSQGTFTSDYSKYLDEQAAKEFICWLMNT

SEQ ID NO: 520 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  MOD_RES (29)..(29): Cys-PEG
XSQGTFTSDYSKYLDEQAAKEFIAWLMNC

SEQ ID NO: 521 - protein, 39 aa, Artificial Sequence
  Synthetic peptide
  MISC_FEATURE: c-term amidation
HSQGTFTSDYSKYLDSRRAQDFVQWLMNTGPSSGAPPPS

SEQ ID NO: 522 - protein, 39 aa, Artificial Sequence
  Synthetic peptide
  MISC_FEATURE: c-term amidation
HSQGTFTSDYSKYLDSRRAQDFVQWLMNGGPSSGAPPPS

SEQ ID NO: 523 - protein, 39 aa, Artificial Sequence
  Synthetic peptide
  MISC_FEATURE: c-term amidation
HSQGTFTSDYSKYLDSRRAQDFVQWLMKGGPSSGAPPPS

SEQ ID NO: 524 - protein, 39 aa, Artificial Sequence
  Synthetic peptide
  MISC_FEATURE: c-term amidation
HSQGTFTSDYSKYLDSRRAQDFVQWLVKGGPSSGAPPPS

SEQ ID NO: 525 - protein, 39 aa, Artificial Sequence
  Synthetic peptide
  MISC_FEATURE: c-term amidation
HSQGTFTSDYSKYLDSRRAQDFVQWLMDGGPSSGAPPPS

SEQ ID NO: 526 - protein, 39 aa, Artificial Sequence
  Synthetic peptide
  MISC_FEATURE: c-term amidation
HSQGTFTSDYSKYLDERRAKDFVQWLMDGGPSSGAPPPS

SEQ ID NO: 527 - protein, 30 aa, Artificial Sequence
  Synthetic peptide
  MISC_FEATURE: c-term amidation
HAEGTFTSDVSSYLEGQAAKEFIAWLVKGG

SEQ ID NO: 528 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 529 - protein, 39 aa, Artificial Sequence; identical to SEQ ID NO: 513
  Synthetic peptide
  MISC_FEATURE: c-term amidation
  MOD_RES (1)..(1): Alpha, Alpha Dimethyl Imidiazole Acetic Acid
  MOD_RES (24)..(24): Cys-PEG

SEQ ID NO: 530 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  MOD_RES (24)..(24): Cys-PEG
XSQGTFTSDYSKYLDERRAKDFVCWLMNT

SEQ ID NO: 531 - protein, 40 aa, Artificial Sequence
  Synthetic peptide
  MISC_FEATURE: c-term amidation
  MOD_RES (2)..(2): Aminoisobutyric acid
  MOD_RES (24)..(24): Cys-PEG
  MOD_RES (40)..(40): Cys-PEG
HXQGTFTSDYSKYLDERRAKEFICWLMNGGPSSGAPPPSC

SEQ ID NO: 532 - protein, 41 aa, Artificial Sequence
  Synthetic peptide
  MISC_FEATURE: c-term amidation
  MOD_RES (2)..(2): Aminoisobutyric acid
  MOD_RES (40)..(40): Cys-PEG
  MOD_RES (41)..(41): Cys-PEG
HXQGTFTSDYSKYLDEQAAKEFIAWLMNGGPSSGAPPPSCC

SEQ ID NO: 533 - protein, 39 aa, Artificial Sequence; identical to SEQ ID NO: 490
  Synthetic peptide
  MOD_RES (2)..(2): Aminoisobutyric acid
  MOD_RES (24)..(24): Cys-PEG
  MISC_FEATURE (24)..(24): c-term amidation

SEQ ID NO: 534 - protein, 29 aa, Artificial Sequence
  Synthetic peptide
  MISC_FEATURE: Chimera 2 AIB2 K10-C8 Cys 24-40K
  MISC_FEATURE: c-term amidation
  MOD_RES (2)..(2): Aminoisobutyric acid
  MOD_RES (10)..(10): Acylated with C8 fatty acid
  MOD_RES (24)..(24): Cys-PEG
HXQGTFTSDKSKYLDEQAAKEFICWLMNT

SEQ ID NO: 535 - protein, 29 aa, Artificial Sequence
  Synthetic peptide
  MISC_FEATURE: Chimera 2 AIB2 K10-C14 Cys 24-40K
  MISC_FEATURE: c-term amidation
  MOD_RES (2)..(2): Aminoisobutyric acid
  MOD_RES (10)..(10): Acylated with C14 fatty acid
  MOD_RES (24)..(24): Cys-PEG
HXQGTFTSDKSKYLDEQAAKEFICWLMNT

SEQ ID NO: 536 - protein, 29 aa, Artificial Sequence
  Synthetic peptide
  MISC_FEATURE: Chimera 2 AIB2 K10-C16 Cys24-40K
  MISC_FEATURE: c-term amidation
  MOD_RES (2)..(2): Aminoisobutyric acid
  MOD_RES (10)..(10): Acylated with C16 fatty acid
  MOD_RES (24)..(24): Cys-PEG
HXQGTFTSDKSKYLDEQAAKEFICWLMNT

SEQ ID NO: 537 - protein, 29 aa, Artificial Sequence
  Synthetic peptide
  MISC_FEATURE: Chimera 2 AIB2 K10-C18 Cys24-40K
  MISC_FEATURE: c-term amidation
  MOD_RES (2)..(2): Aminoisobutyric acid
  MOD_RES (10)..(10): Acylated with C18 fatty acid
  MOD_RES (24)..(24): Cys-PEG
HXQGTFTSDKSKYLDEQAAKEFICWLMNT

SEQ ID NO: 538 - protein, 29 aa, Artificial Sequence
  Synthetic peptide
  MISC_FEATURE: Chimera 2 K10-C18 Cys24-40K
  MISC_FEATURE: c-term amidation
  MOD_RES (10)..(10): Acylated with C18 fatty acid
  MOD_RES (24)..(24): Cys-PEG
HSQGTFTSDKSKYLDEQAAKEFICWLMNT

SEQ ID NO: 539 - protein, 29 aa, Artificial Sequence
  Synthetic peptide
  MISC_FEATURE: Glucagon E16 K20 K10-C18 Cys24-40K
  MOD_RES (10)..(10): Acylated with C18 fatty acid
  MOD_RES (24)..(24): Cys-PEG
HSQGTFTSDKSKYLDERRAKDFVCWLMNT

SEQ ID NO: 540 - protein, 29 aa, Artificial Sequence
  Synthetic peptide
  MISC_FEATURE: Glucagon E16 K20 K10-W-C18
  MISC_FEATURE: c-term amidation
  MOD_RES (10)..(10): Covalently bound to Trp residue comprising a C18 fatty acid
HSQGTFTSDKSKYLDERRAKDFVQWLMNT

SEQ ID NO: 541 - protein, 29 aa, Artificial Sequence
  Synthetic peptide
  MISC_FEATURE: Glucagon E16 K20 K10-W-C16 Cys24-40K
  MOD_RES (10)..(10): Covalently bound to Trp residue comprising a C16 fatty acid
  MOD_RES (24)..(24): Cys-PEG
HSQGTFTSDKSKYLDERRAKDFVCWLMNT

SEQ ID NO: 542 - protein, 29 aa, Artificial Sequence
  Synthetic peptide
  MISC_FEATURE: Glucagon E16 K20 K10-C16
  MISC_FEATURE: c-term amidation
  MOD_RES (10)..(10): Covalently bound to C16 fatty acid
HSQGTFTSDKSKYLDERRAKDFVQWLMNT

SEQ ID NO: 543 - protein, 29 aa, Artificial Sequence
  Synthetic peptide
  MISC_FEATURE: Glucagon E16 K20 K10-C16
  MISC_FEATURE: c-term amidation
  MOD_RES (10)..(10): Covalently bound to Trp residue comprising a C16 fatty acid
HSQGTFTSDKSKYLDERRAKDFVQWLMNT

SEQ ID NO: 544 - protein, 29 aa, Artificial Sequence
  Synthetic peptide
  MISC_FEATURE: Glucagon E16 K20 K10-C18
  MISC_FEATURE: c-term amidation
  MOD_RES (10)..(10): Covalently bound to C18 fatty acid
HSQGTFTSDKSKYLDERRAKDFVQWLMNT

SEQ ID NO: 545 - protein, 29 aa, Artificial Sequence
  Synthetic peptide
  MISC_FEATURE: Glucagon E16 K20
  MISC_FEATURE: c-term amidation
HSQGTFTSDYSKYLDERRAKDFVQWLMNT

SEQ ID NO: 546 - protein, 29 aa, Artificial Sequence
  Synthetic peptide
  MISC_FEATURE: Glucagon E16 K20 K10-W-C16 Cys 24-40K
  MISC_FEATURE: c-term amidation
  MOD_RES (10)..(10): Covalently bound to Trp residue comprising C16 fatty acid
  MOD_RES (24)..(24): Cys-PEG
HSQGTFTSDKSKYLDERRAKDFVCWLMNT

SEQ ID NO: 547 - protein, 29 aa, Artificial Sequence
  Synthetic peptide
  MISC_FEATURE: Glucagon E16 K20 K10-C18 Cys24-40K
  MISC_FEATURE: c-term amidation
  MOD_RES (10)..(10): Covalently bound to C18 fatty acid
  MOD_RES (24)..(24): Cys-PEG
HSQGTFTSDKSKYLDERRAKDFVCWLMNT

SEQ ID NO: 548 - protein, 29 aa, Artificial Sequence
  Synthetic peptide
  MISC_FEATURE: Glucagon E16 K20 K10-C18 Cys24-40K
  MISC_FEATURE: c-term amidation
  MOD_RES (10)..(10): Covalently bound to Trp residue comprising a C18 fatty acid
  MOD_RES (24)..(24): Cys-PEG
HSQGTFTSDKSKYLDERRAKDFVCWLMNT

SEQ ID NO: 549 - protein, 29 aa, Artificial Sequence
  Synthetic peptide
  MISC_FEATURE: Glucagon E16 K20 K10-C16 amide
  MISC_FEATURE: c-term amidation
  MOD_RES (10)..(10): Covalently bound to Glu residue comprising a C16 fatty acid
  MOD_RES (24)..(24): Cys-PEG
HSQGTFTSDKSKYLDERRAQDFVCWLMNT

SEQ ID NO: 550 - protein, 28 aa, Artificial Sequence
  Synthetic peptide
  MISC_FEATURE: Chimera 2 truncated by one amino acid
HSQGTFTSDYSKYLDEQAAKEFIAWLMN

SEQ ID NO: 551 - protein, 27 aa, Artificial Sequence
  Synthetic peptide
  MISC_FEATURE: Chimera 2 truncated by two amino acids
HSQGTFTSDYSKYLDEQAAKEFIAWLM

SEQ ID NO: 552 - protein, 28 aa, Artificial Sequence
  Synthetic peptide
  MISC_FEATURE: aa 1-28, E16 K20 C-terminal amide
  MISC_FEATURE: c-term amidation
HSQGTFTSDYSKYLDERRAKDFVQWLMN

SEQ ID NO: 553 - protein, 27 aa, Artificial Sequence
  Synthetic peptide
  MISC_FEATURE: aa 1-27 E16 K20 C-terminal amide
  MISC_FEATURE: c-term amidation
HSQGTFTSDYSKYLDERRAKDFVQWKM

SEQ ID NO: 554 - protein, 29 aa, Artificial Sequence
  Synthetic peptide
  MISC_FEATURE: c-term amidation
  MOD_RES (27)..(27): Norleucine
HSEGTFTSDYSKYLDEQAAKEFIAWLXNT

SEQ ID NO: 555 - protein, 39 aa, Artificial Sequence
  Synthetic peptide
  MISC_FEATURE (16)..(20): Lactam bridging side chains at positions 16 and 20
YSQGTFTSDYSKYLDEQAAKEFVNWLMNGGPSSGAPPPS

SEQ ID NO: 556 - protein, 29 aa, Artificial Sequence
  Synthetic peptide
  MISC_FEATURE: Chimera 2 with AIB at 16
  MISC_FEATURE: c-term amidation
  MOD_RES (16)..(16): Aminoisobutyric acid
HSQGTFTSDYSKYLDXQAAKEFIAWLMNT

SEQ ID NO: 557 - protein, 29 aa, Artificial Sequence
  Synthetic peptide
  MISC_FEATURE: c-term amidation
  MOD_RES (2)..(2): Aminoisobutyric acid
  MOD_RES (16)..(16): Aminoisobutyric acid
HXQGTFTSDYSKYLDXRRAQDFVQWLMNT

SEQ ID NO: 558 - protein, 29 aa, Artificial Sequence
  Synthetic peptide
  MISC_FEATURE: c-term amidation
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (24)..(24): Cys-PEG
HXQGTFTSDKSKYLDXRRAQDFVCWLMNT

SEQ ID NO: 559 - protein, 29 aa, Artificial Sequence
  Synthetic peptide
  MISC_FEATURE: c-term amidation
  MOD_RES (2)..(2): Aminoisobutric Acid
  MISC_FEATURE (10)..(10): Covalently bound to Trp residue comprising a C16 fatty acid
  MOD_RES (16)..(16): Aminoisobutric Acid
HXQGTFTSDKSKYLDXRRAQDFVCWLMNT

SEQ ID NO: 560 - protein, 29 aa, Artificial Sequence
  Synthetic peptide
  MISC_FEATURE: c-term amidation
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (20)..(20): Aminoisobutyric acid
  MOD_RES (24)..(24): Cys-PEG
HXQGTFTSDKSKYLDXRRAXDFVCWLMNT

SEQ ID NO: 561 - protein, 29 aa, Artificial Sequence
  Synthetic peptide
  MISC_FEATURE: c-term amidation
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (20)..(20): Aminoisobutyric acid
HXQGTFTSDKSKYLDXRRAXDFVCWLMNT

SEQ ID NO: 562 - protein, 29 aa, Artificial Sequence
  Synthetic peptide
  MISC_FEATURE: c-term amidation
  MOD_RES (2)..(2): Aminoisobutyric acid
  MOD_RES (16)..(16): Aminoisobutyric acid
HXQGTFTSDKSKYLDXRRAQDFVQWLMNT

SEQ ID NO: 563 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C16 fatty acyl group
  MOD_RES (16)..(16): Aminoisobutyric Acid
HXQGTFTSDKSKYLDXRRAQDFVQWLMNT

SEQ ID NO: 564 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C16 fatty acyl group via Ala-Ala spacer
  MOD_RES (16)..(16): Aminoisobutyric Acid
HXQGTFTSDKSKYLDXRRAQDFVQWLMNT

SEQ ID NO: 565 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via gamma-Glu-gamma-Glu spacer
  MOD_RES (16)..(16): Aminoisobutryic Acid
HXQGTFTSDKSKYLDXRRAQDFVQWLMNT

SEQ ID NO: 566 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via beta-Ala-beta-Ala spacer
  MOD_RES (16)..(16): Aminoisobutryic Acid
HXQGTFTSDKSKYLDXRRAQDFVQWLMNT

SEQ ID NO: 567 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via 6-aminohexanoic acid spacer
  MOD_RES (16)..(16): Aminoisobutryic Acid
HXQGTFTSDKSKYLDXRRAQDFVQWLMNT

SEQ ID NO: 568 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via Leu-Leu spacer
  MOD_RES (16)..(16): Aminoisobutryic Acid
HXQGTFTSDKSKYLDXRRAQDFVQWLMNT

SEQ ID NO: 569 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via Pro-Pro spacer
  MOD_RES (16)..(16): Aminoisobutryic Acid
HXQGTFTSDKSKYLDXRRAQDFVQWLMNT

SEQ ID NO: 570 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C14 fatty acyl group
  MOD_RES (16)..(16): Aminoisobutyric Acid
  MOD_RES (24)..(24): Pegylated
HXQGTFTSDKSKYLDXRRAQDFVCWLMNT

SEQ ID NO: 571 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C14 fatty acyl group via gamma-Glu-gamma-Glu spacer
  MOD_RES (16)..(16): Aminoisobutyric Acid
  MOD_RES (24)..(24): Pegylated
HXQGTFTSDKSKYLDXRRAQDFVCWLMNT

SEQ ID NO: 572 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via gamma-Glu-gamma-Glu spacer
  MOD_RES (16)..(16): Aminoisobutryic Acid
HXQGTFTSDKSKYLDXRRAQDFVQWLMNT

SEQ ID NO: 573 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via Ala-Ala spacer
  MOD_RES (16)..(16): Aminoisobutryic Acid
  MOD_RES (24)..(24): Pegylated
HXQGTFTSDKSKYLDXRRAQDFVCWLMNT

SEQ ID NO: 574 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via Ala-Ala spacer
  MOD_RES (16)..(16): Aminoisobutryic Acid
HXQGTFTSDKSKYLDXRRAQDFVQWLMNT

SEQ ID NO: 575 - protein, 29 aa, Artificial Sequence
  Synthetic peptide
  MISC_FEATURE: c-term amidation
  MOD_RES (2)..(2): Aminoisobutryic acid
  MOD_RES (10)..(10): Acylated with a C16 fatty acyl group via Ala-Ala spacer
  MOD_RES (16)..(16): Aminoisobutryic acid
  MOD_RES (24)..(24): Pegylated
HXQGTFTSDKSKYLDXRRAQDFVCWLMNT

SEQ ID NO: 576 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via gamma-Glu-gamma-Glu spacer
  MOD_RES (16)..(16): Aminoisobutryic Acid
  MOD_RES (24)..(24): Pegylated
HXQGTFTSDKSKYLDXRRAQDFVCWLMNT

SEQ ID NO: 577 - protein, 29 aa, Artificial Sequence
  Synthetic peptide
  MISC_FEATURE: c-term amidation
  MOD_RES (10)..(10): Acylated with a C16 fatty acyl group
HSQGTFTSDKSKYLDSRRAQDFVQWLMNT

SEQ ID NO: 578 - protein, 29 aa, Artificial Sequence
  Synthetic peptide
  MISC_FEATURE: c-term amidation
  MOD_RES (10)..(10): Acylated with a C16 fatty acyl group via gamma-Glu-gamma-Glu spacer
HSQGTFTSDKSKYLDSRRAQDFVQWLMNT

SEQ ID NO: 579 - protein, 29 aa, Artificial Sequence
  Synthetic peptide
  MISC_FEATURE: AA-C16 Glucagon Amide
  MISC_FEATURE: c-term amidation
  MOD_RES (10)..(10): Acylated with a C16 fatty acyl group via Ala-Ala spacer
HSQGTFTSDKSKYLDSRRAQDFVQWLMNT

SEQ ID NO: 580 - protein, 29 aa, Artificial Sequence
  Synthetic peptide
  MISC_FEATURE: Chimera 2, AIB2, Lys10, Cys24-PEG
  MISC_FEATURE: c-term amidation
  MOD_RES (2)..(2): Aminoisobutryic Acid
  MOD_RES (24)..(24): Pegylated
HXQGTFTSDKSKYLDEQAAKEFICWLMNT

SEQ ID NO: 581 - protein, 30 aa, Artificial Sequence
  Synthetic peptide
  MISC_FEATURE: Peptide dS2E16K20K30-C14 Gluc Amide
  MISC_FEATURE: c-term amidation
  MOD_RES (2)..(2): Xaa is d-Ser
  MOD_RES (30)..(30): Acylated with a C14 fatty acyl group
HXQGTFTSDYSKYLDERRAKDFVQWLMNTK

SEQ ID NO: 582 - protein, 29 aa, Artificial Sequence
  Synthetic peptide
  MISC_FEATURE: Peptide dS2K10(C14)E16K20-Gluc Amide
  MISC_FEATURE: c-term amidation
  MOD_RES (2)..(2): Xaa is d-Ser
  MOD_RES (10)..(10): Acylated with a C14 fatty acyl group
HXQGTFTSDKSKYLDERRAKDFVQWLMNT

SEQ ID NO: 583 - protein, 30 aa, Artificial Sequence; identical to SEQ ID NO: 581
  Synthetic peptide
  MISC_FEATURE: Peptide dS2E16K20K30-C16 Gluc Amide
  MISC_FEATURE: c-term amidation
  MOD_RES (2)..(2): Xaa is d-Ser
  MOD_RES (30)..(30): Acylated with a C16 fatty acyl group

SEQ ID NO: 584 - protein, 29 aa, Artificial Sequence
  Synthetic peptide
  MISC_FEATURE: Peptide dS2K10(C16)E16K20-Gluc Amide
  MISC_FEATURE: c-term amidation
  MOD_RES (2)..(2): Xaa is d-Ser
  MOD_RES (10)..(10): Acylated with a C16 fatty acyl group
HXQGTFTSDKSKYLDERRAKDFVQWLMNT

SEQ ID NO: 585 - protein, 29 aa, Artificial Sequence
  Synthetic peptide
  MISC_FEATURE: Peptide Chimera 2-AIB2-K10-acylated
  MISC_FEATURE: c-term amidation
  MOD_RES (2)..(2): Aminoisobutryic Acid
  MOD_RES (10)..(10): Acylated with a C18 fatty acyl group
  MOD_RES (24)..(24): Pegylated
HXQGTFTSDKSKYLDEQAAKEFICWLMNT

SEQ ID NO: 586 - protein, 30 aa, Artificial Sequence
  Synthetic peptide
  MISC_FEATURE: Peptide Chimera 2-AIB2-K30-acylated
  MISC_FEATURE: c-term amidation
  MOD_RES (2)..(2): Aminoisobutryic Acid
  MOD_RES (24)..(24): Pegylated
  MOD_RES (30)..(30): Acylated with a C18 fatty acyl group
HXQGTFTSDYSKYLDEQAAKEFICWLMNTK

SEQ ID NO: 587 - protein, 29 aa, Artificial Sequence
  Synthetic peptide
  MISC_FEATURE: c-term amidation
  MOD_RES (1)..(1): DMIA
XSQGTFTSDYSKYLDERRAKDFVCWLMNT

SEQ ID NO: 588 - protein, 29 aa, Artificial Sequence
  Synthetic peptide
  MISC_FEATURE: c-term amidation
  MOD_RES (1)..(1): DMIA
  MOD_RES (16)..(20): Lactam ring between side chains of amino acids at positions 16 and 20
XSQGTFTSDYSKYLDERRAKDFVCWLMNT

SEQ ID NO: 589 - protein, 29 aa, Artificial Sequence
  Synthetic peptide
  MISC_FEATURE: c-term amidation
  MOD_RES (2)..(2): Aminoisobutryic Acid
HXEGTFTSDYSKYLDEQAAKEFICWLMNT

SEQ ID NO: 590 - protein, 29 aa, Artificial Sequence
  Synthetic peptide
  MISC_FEATURE: c-term amidation
  MOD_RES (2)..(2): Aminoisobutryic Acid
  MOD_RES (24)..(24): Pegylated
HXEGTFTSDYSKYLDEQAAKEFICWLMNT

SEQ ID NO: 591 - protein, 29 aa, Artificial Sequence
  Synthetic peptide
  MOD_RES (3)..(3): Xaa is a Glutamine analog
  MOD_RES (27)..(27): Xaa is Norleucine
HSXGTFTSDYSKYLDTRRAAEFVAWLXDE

SEQ ID NO: 592 - protein, 29 aa, Artificial Sequence
  Synthetic peptide
  MOD_RES (3)..(3): Xaa is a Glutamine analog
  MOD_RES (16)..(16): Xaa is Aib
HSXGTFTSDYSKYLDXRRAADFVAWLMDE

SEQ ID NO: 593 - protein, 29 aa, Artificial Sequence
  Synthetic peptide
  MOD_RES (27)..(27): Xaa is Norleucine
HSQGTFTSDYSKYLDTRRAAEFVAWLXDE

SEQ ID NO: 594 - protein, 29 aa, Artificial Sequence
  Synthetic peptide
  MOD_RES (3)..(3): Xaa is Acetamidomethyl-cysteine
  MOD_RES (27)..(27): Xaa is Norleucine
HSXGTFTSDYSKYLDTRRAAEFVAWLXDE

SEQ ID NO: 595 - protein, 29 aa, Artificial Sequence
  Synthetic peptide
  MOD_RES (3)..(3): Xaa is Acetyldiaminobutanoic acid
  MOD_RES (27)..(27): Xaa is Norleucine
HSXGTFTSDYSKYLDTRRAAEFVAWLXDE

SEQ ID NO: 596 - protein, 29 aa, Artificial Sequence
  Synthetic peptide
  MOD_RES (3)..(3): Xaa is carbamoyldiaminopropanoic acid
  MOD_RES (27)..(27): Xaa is Norleucine
HSXGTFTSDYSKYLDTRRAAEFVAWLXDE

SEQ ID NO: 597 - protein, 29 aa, Artificial Sequence
  Synthetic peptide
  MOD_RES (3)..(3): Xaa is Methylglutamine
  MOD_RES (27)..(27): Xaa is Norleucine
HSXGTFTSDYSKYLDTRRAAEFVAWLXDE

SEQ ID NO: 598 - protein, 29 aa, Artificial Sequence
  Synthetic peptide
  MOD_RES (3)..(3): Xaa is Methionine sulfoxide
  MOD_RES (27)..(27): Xaa is Norleucine
HSXGTFTSDYSKYLDTRRAAEFVAWLXDE

SEQ ID NO: 599 - protein, 29 aa, Artificial Sequence
  Synthetic peptide
  MOD_RES (3)..(3): Acetylornithine
  MOD_RES (27)..(27): Xaa is Norleucine
HSXGTFTSDYSKYLDTRRAAEFVAWLXDE

SEQ ID NO: 600 - protein, 29 aa, Artificial Sequence
  Synthetic peptide
  MOD_RES (16)..(16): Xaa is Aminoisobutryic Acid
HSQGTFTSDYSKYLDXRRAADFVAWLMDE

SEQ ID NO: 601 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutyric Acid
HSXGTFTSDYSKYLDXRRAADFVAWLMDE

SEQ ID NO: 602 - protein, 29 aa, Artificial Sequence
  Synthetic peptide
  MOD_RES (3)..(3): Xaa is Methylglutamine
  MOD_RES (16)..(16): Xaa is Aminoisobutyric Acid
HSXGTFTSDYSKYLDXRRAADFVAWLMDE

SEQ ID NO: 603 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRAADFVAWLLDE

SEQ ID NO: 604 - protein, 39 aa, Artificial Sequence
  Synthetic peptide
  MISC_FEATURE: c-term amidation
  MOD_RES (3)..(3): Xaa is Acetyldiaminobutanoic acid
  MOD_RES (16)..(16): Xaa is Aminoisobutyric Acid
HSXGTFTSDYSKYLDXRRAADFVAWLLDTGPSSGAPPPS

SEQ ID NO: 605 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRASDFVSWLLDE

SEQ ID NO: 606 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRATDFVTWLLDE

SEQ ID NO: 607 - protein, 29 aa, Artificial Sequence
  Synthetic peptide
  MISC_FEATURE: c-term amidation
  MOD_RES (1)..(1): Xaa is Dmia
  MOD_RES (10)..(10): Covalently bound to a C14 fatty acyl group
  MOD_RES (16)..(20): Lactam ring between side chains of amino acids at positions 16 and 20
XSQGTFTSDKSKYLDERRAKDFVQWLMNT

SEQ ID NO: 608 - protein, 29 aa, Artificial Sequence
  Synthetic peptide
  MISC_FEATURE: c-term amidation
  MOD_RES (1)..(1): DMIA
  MOD_RES (10)..(10): Covalently bound to C16 fatty acyl group
  MOD_RES (16)..(20): Lactam ring between side chains of amino acids at positions 16 and 20
XSQGTFTSDKSKYLDERRAKDFVQWLMNT

SEQ ID NO: 609 - protein, 29 aa, Artificial Sequence
  Synthetic peptide
  MISC_FEATURE: c-term amidation
  MOD_RES (1)..(1): DMIA
  MOD_RES (10)..(10): Covalently bound to C18 fatty acyl group
  MOD_RES (16)..(20): Lactam ring between side chains of amino acids at positions 16 and 20
XSQGTFTSDKSKYLDERRAKDFVQWLMNT

SEQ ID NO: 610 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group
  MOD_RES (16)..(16): Aminoisobutryic Acid
HXQGTFTSDKSKYLDXRRAQDFVQWLMNT

SEQ ID NO: 611 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C16 fatty acyl group
  MOD_RES (16)..(16): Aminoisobutryic Acid
HXQGTFTSDKSKYLDXRRAQDFVQWLMNT

SEQ ID NO: 612 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C18 fatty acyl group
  MOD_RES (16)..(16): Aminoisobutryic Acid
HXQGTFTSDKSKYLDXRRAQDFVQWLMNT

SEQ ID NO: 613 - protein, 29 aa, Artificial Sequence
  Synthetic peptide
  MISC_FEATURE: c-term amidation
  MOD_RES (2)..(2): Xaa is d-Ser
  MOD_RES (10)..(10): Covalently bound to C14 fatty acyl group
HXQGTFTSDKSKYLDERRAKDFVQWLMNT

SEQ ID NO: 614 - protein, 29 aa, Artificial Sequence
  Synthetic peptide
  MISC_FEATURE: c-term amidation
  MOD_RES (2)..(2): Xaa is d-Ser
  MOD_RES (10)..(10): Covalently bound to C16 fatty acyl group
HXQGTFTSDKSKYLDERRAKDFVQWLMNT

SEQ ID NO: 615 - protein, 29 aa, Artificial Sequence
  Synthetic peptide
  MISC_FEATURE: c-term amidation
  MOD_RES (2)..(2): Xaa is d-Ser
  MOD_RES (10)..(10): Covalently bound to a C18 fatty acyl group
HXQGTFTSDKSKYLDERRAKDFVQWLMNT

SEQ ID NO: 616 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covalently bound to a C14 fatty acyl group
  MOD_RES (16)..(16): Aminoisobutyric Acid
HXQGTFTSDKSKYLDXRRAQDFVCWLMNT

SEQ ID NO: 617 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group via gamma-Glu-gamma-Glu spacer
  MOD_RES (16)..(16): Aminoisobutryic Acid
HXQGTFTSDKSKYLDXRRAQDFVCWLMNT

SEQ ID NO: 618 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group via Ala-Ala spacer
  MOD_RES (16)..(16): Aminoisobutryic Acid
HXQGTFTSDKSKYLDXRRAQDFVCWLMNT

SEQ ID NO: 619 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covalently bound to C16 fatty acyl group via di peptide spacer
  MOD_RES (16)..(16): Aminoisobutyric Acid
HXQGTFTSDKSKYLDXRRAQDFVCWLMNT

SEQ ID NO: 620 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covelently bound to C16 fatty acyl group via Ala-Ala spacer
  MOD_RES (16)..(16): Aminoisobutyric Acid
HXQGTFTSDKSKYLDXRRAQDFVCWLMNT

SEQ ID NO: 621 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covalently bound to C16 fatty acyl group
  MOD_RES (16)..(16): Aminoisobutyric Acid
HXQGTFTSDKSKYLDXRRAQDFVCWLMNT

SEQ ID NO: 622 - protein, 30 aa, Artificial Sequence
  Synthetic peptide
  MISC_FEATURE: c-term amidation
  MOD_RES (2)..(2): Aminoisobutyric Acid
  MOD_RES (10)..(10): Covalently bound to C16 fatty acyl group
  MOD_RES (16)..(16): Aminoisobutyric Acid
HXQGTFTSDKSKYLDXRRAQDFVCWLMNTK

SEQ ID NO: 623 - protein, 29 aa, Artificial Sequence
  Synthetic peptide
  MISC_FEATURE: beta-Ala-beta-Ala - C16 Glucagon Amide
  MISC_FEATURE: c-term amidation
  MISC_FEATURE (10)..(10): Acylated with a C16 fatty acyl group via beta-Ala-beta-Ala spacer
HSQGTFTSDKSKYLDSRRAQDFVQWLMNT

SEQ ID NO: 624 - protein, 29 aa, Artificial Sequence
  Synthetic peptide
  MISC_FEATURE: Chimera-2 Aib2C24Mal40KPEG
  MOD_RES (2)..(2): Xaa is Aib
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDEQAAKEFICWLMNT

SEQ ID NO: 625 - protein, 29 aa, Artificial Sequence
  Synthetic peptide
  MISC_FEATURE: Chimera-2 Aib2E16K20lactamC24Mal40KPEG
  MOD_RES (2)..(2): Xaa is Aib
  MISC_FEATURE (16)..(20): Lactam ring between side chains of the amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDEQAAKEFICWLMNT

SEQ ID NO: 626 - protein, 29 aa, Artificial Sequence
  Synthetic peptide
  MISC_FEATURE: Glucagon Aib2E16K20lactamC24amideMal40KPEG
  MOD_RES (2)..(2): Xaa is Aib
  MISC_FEATURE (16)..(20): Lactam ring between side chains of amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDERRAKDFVCWLMNT

SEQ ID NO: 627 - skipped

SEQ ID NO: 628 - protein, 29 aa, Artificial Sequence
  Synthetic peptide
  MISC_FEATURE: Glucagon Dmia1E16K20lactamC24Mal40KPEG
  MOD_RES (1)..(1): Xaa is Dmia
  MISC_FEATURE (16)..(20): Lactam ring between side chains of amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
XSQGTFTSDYSKYLDERRAKDFVCWLMNT

SEQ ID NO: 629 - protein, 29 aa, Artificial Sequence
  Synthetic peptide
  MISC_FEATURE: Glucagon Dmia1E16K20lactamC24Mal40KPEG
  MOD_RES (1)..(1): Xaa is Dmia
  MISC_FEATURE (16)..(20): Lactam ring between side chains of amino acids at positions 16 and 20
  MISC_FEATURE (24)..(24): Covalently bound to 40kDa PEG via thioether made by reaction of peptide with a maleimide-activated PEG
XSQGTFTSDYSKYLDERRAKDFVCWLMNT

SEQ ID NO: 630 - protein, 29 aa, Artificial Sequence
  Synthetic peptide
  MISC_FEATURE: Glucagon Dmia1E16K20lactamC24thioether40KPEG
  MOD_RES (1)..(1): Xaa is Dmia
  MISC_FEATURE (16)..(20): Lactam ring between side chains of amino acids at position 16 and 20
  MOD_RES (24)..(24): Covalently bound to 40kDa PEG via thioether made by reaction of peptide with haloacetyl-activated PEG
  MOD_RES (29)..(29): AMIDATION
XSQGTFTSDYSKYLDERRAKDFVCWLMNT

SEQ ID NO: 631 - protein, 29 aa, Artificial Sequence
  Synthetic peptide
  MISC_FEATURE: Chimera2 Aib2E3C24-Thioether40K PEG(NOF)
  MOD_RES (2)..(2): Xaa is Aib
  MOD_RES (24)..(24): Covalently bound to 40kDa PEG via thioether made by reaction of peptide with haloacetyl-activated PEG
  MOD_RES (29)..(29): AMIDATION
HXEGTFTSDYSKYLDEQAAKEFICWLMNT

SEQ ID NO: 632 - protein, 29 aa, Artificial Sequence
  Synthetic peptide
  MOD_RES (1)..(1): Xaa is Dmia
  MOD_RES (24)..(24): Covalently bound to 40kDa PEG
  MOD_RES (29)..(29): AMIDATION
XSEGTFTSDYSKYLEERRAKDFVCWLMNT

SEQ ID NO: 633 - protein, 29 aa, Artificial Sequence
  Synthetic peptide
  MISC_FEATURE: Glucagon Aib2Aib16C24K10(rErE-C16) C24PEG40K amide
  MOD_RES (2)..(2): Xaa is Aib
  MOD_RES (10)..(10): Covalently bound to C14 fatty acyl group via gamma-Glu-gamma-Glu spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 634 - protein, 29 aa, Artificial Sequence
  Synthetic peptide
  MISC_FEATURE: Glucagon Aib2Aib16K10(AA-C14)C24PEG40K TE amide
  MOD_RES (2)..(2): Xaa is Aib
  MOD_RES (10)..(10): Covalently bound to C14 fatty acyl group via Ala-Ala spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 635 - protein, 29 aa, Artificial Sequence
  Synthetic peptide
  MISC_FEATURE: Glucagon Aib2Aib16K10(AA-C16) amide
  MOD_RES (2)..(2): Xaa is Aib
  MOD_RES (10)..(10): Covalently bound to C16 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 636 - protein, 29 aa, Artificial Sequence
  Synthetic peptide
  MISC_FEATURE: Glucagon Aib2Aib16K10(rErE-C16) amide
  MOD_RES (2)..(2): Xaa is Aib
  MOD_RES (10)..(10): Covalently bound to C16 fatty acyl group via gamma-Glu-gamma-Glu spacer
  MOD_RES (16)..(16): Xaa is Aib
  MOD_RES (29)..(29): AMIDATION
HXQGTFTSDKSKYLDXRRAQDFVQWLMNT

SEQ ID NO: 637 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDYSKYLDXRRAQDFVQWLMNT

SEQ ID NO: 638 - DNA, 20 bp, Artificial Sequence
  Synthetic primer
caaggtccagggaggttgtg

SEQ ID NO: 639 - DNA, 24 bp, Artificial Sequence
  Synthetic primer
ccaaaggtaagctgtccataagga

SEQ ID NO: 640 - DNA, 22 bp, Artificial Sequence
  Synthetic primer
ctctcccaagagtcacatgtcc

SEQ ID NO: 641 - DNA, 22 bp, Artificial Sequence
  Synthetic primer
caataactcggtcccctacaac

SEQ ID NO: 642 - protein, 29 aa, Artificial Sequence
  Synthetic peptide
HSQGTFTSDYSKYLDSRRAQDFVQWLMDT

SEQ ID NO: 643 - protein, 29 aa, Artificial Sequence
  Synthetic peptide
  MISC_FEATURE: c-term amidation
  MOD_RES (2)..(2): Xaa is d-Ser
  MOD_RES (10)..(10): Acylated with a C16 fatty acyl group via gamma-Glu spacer
HXQGTFTSDKSKYLDEQAAKEFIAWLMNT

SEQ ID NO: 644 - protein, 29 aa, Artificial Sequence
  Synthetic peptide
  MISC_FEATURE: c-term amidation
  MOD_RES (2)..(2): Xaa is d-Ser
  MOD_RES (10)..(10): Acylated with a C16 fatty acyl group via gamma-Glu-gamma-Glu spacer
HXQGTFTSDKSKYLDEQAAKEFIAWLMNT

SEQ ID NO: 645 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu spacer
HXQGTFTSDKSKYLDEQAAKEFIAWLMNT

SEQ ID NO: 646 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
HXQGTFTSDKSKYLDEQAAKEFIAWLMNT

SEQ ID NO: 647 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group
HXEGTFTSDKSKYLDEQAAKEFIAWLMNT

SEQ ID NO: 648 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
HXEGTFTSDKSKYLDEQAAKEFIAWLMNT

SEQ ID NO: 649 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu spacer
HXQGTFISDKSKYLDEQAAKEFIAWLMNT

SEQ ID NO: 650 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
HXQGTFISDKSKYLDEQAAKEFIAWLMNT

SEQ ID NO: 651 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via gamma-Glu spacer
  MISC_FEATURE (16)..(20): Lactam ring between side chains of amino acids at positions 16 and 20
XSQGTFTSDKSKYLDERRAKDFVQWLMNT

SEQ ID NO: 652 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via gamma-Glu-gamma-Glu spacer
  MISC_FEATURE (16)..(20): Lactam ring between side chains of amino acids at positions 16 and 20
XSQGTFTSDKSKYLDERRAKDFVQWLMNT

SEQ ID NO: 653 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via gamma-Glu spacer
XSQGTFTSDYSKYLDERRAKDFVQWLMNK

SEQ ID NO: 654 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via gamma-Glu-gamma-Glu spacer
XSQGTFTSDYSKYLDERRAKDFVQWLMNK

SEQ ID NO: 655 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
  MOD_RES (16)..(16): Xaa is Aib
HXQGTFTSDKSKYLDXRAAQDFVQWLMDT

SEQ ID NO: 656 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu spacer
  MOD_RES (16)..(16): Xaa is Aib
HXQGTFTSDKSKYLDXRAAQDFVQWLMDT

SEQ ID NO: 657 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via dipeptide spacer
  MOD_RES (16)..(16): Aminoisobutryic Acid
HXQGTFTSDKSKYLDXRRAQDFVQWLMNT

SEQ ID NO: 658 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C14 fatty acyl group via dipeptide spacer
  MOD_RES (16)..(16): Aminoisobutyric Acid
  MOD_RES (24)..(24): Pegylated
HXQGTFTSDKSKYLDXRRAQDFVCWLMNT

SEQ ID NO: 659 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via dipeptide spacer
  MOD_RES (16)..(16): Aminoisobutryic Acid
HXQGTFTSDKSKYLDXRRAQDFVQWLMNT

SEQ ID NO: 660 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via dipeptide spacer
  MOD_RES (16)..(16): Aminoisobutryic Acid
  MOD_RES (24)..(24): Pegylated
HXQGTFTSDKSKYLDXRRAQDFVCWLMNT

SEQ ID NO: 661 - protein, 29 aa, Artificial Sequence
  Synthetic peptide
  MISC_FEATURE: c-term amidation
  MOD_RES (10)..(10): Acylated with a C16 fatty acyl group via dipeptide spacer
HSQGTFTSDKSKYLDSRRAQDFVQWLMNT

SEQ ID NO: 662 - protein, 30 aa, Artificial Sequence; identical to SEQ ID NO: 581
  Synthetic peptide
  MISC_FEATURE: Peptide dS2E16K20K30-C14 Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (30)..(30): Acylated with a C14 fatty acyl group

SEQ ID NO: 663 - protein, 29 aa, Artificial Sequence
  Synthetic peptide
  MISC_FEATURE: Peptide dS2K10(C14)E16K20-Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C14 fatty acyl group
HXQGTFTSDKSKYLDERRAKDFVQWLMNT

SEQ ID NO: 664 - protein, 30 aa, Artificial Sequence; identical to SEQ ID NO: 581
  Synthetic peptide
  MISC_FEATURE: Peptide dS2E16K20K30-C16 Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (30)..(30): Acylated with a C16 fatty acyl group

SEQ ID NO: 665 - protein, 29 aa, Artificial Sequence
  Synthetic peptide
  MISC_FEATURE: Peptide dS2K10(C16)E16K20-Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group
HXQGTFTSDKSKYLDERRAKDFVQWLMNT

SEQ ID NO: 666 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Covalently bound to C14 fatty acyl group
HXQGTFTSDKSKYLDERRAKDFVQWLMNT

SEQ ID NO: 667 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Covalently bound to C16 fatty acyl group
HXQGTFTSDKSKYLDERRAKDFVQWLMNT

SEQ ID NO: 668 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Covalently bound to a C18 fatty acyl group
HXQGTFTSDKSKYLDERRAKDFVQWLMNT

SEQ ID NO: 669 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group via dipeptide spacer
  MOD_RES (16)..(16): Aminoisobutryic Acid
HXQGTFTSDKSKYLDXRRAQDFVCWLMNT

SEQ ID NO: 670 - protein, 29 aa, Artificial Sequence
  Synthetic peptide
  MISC_FEATURE: Glucagon Aib2Aib16C24K10(rErE-C16) C24PEG40K amide
  MOD_RES (2)..(2): Xaa is Aib
  MOD_RES (10)..(10): Covalently bound to C14 fatty acyl group via dipeptide spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 671 - protein, 29 aa, Artificial Sequence
  Synthetic peptide
  MISC_FEATURE: Glucagon Aib2Aib16K10(rErE-C16) amide
  MOD_RES (2)..(2): Xaa is Aib
  MOD_RES (10)..(10): Covalently bound to C16 fatty acyl group via dipeptide spacer
  MOD_RES (16)..(16): Xaa is Aib
  MOD_RES (29)..(29): AMIDATION
HXQGTFTSDKSKYLDXRRAQDFVQWLMNT

SEQ ID NO: 672 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group via acidic amino acid spacer
HXQGTFTSDKSKYLDEQAAKEFIAWLMNT

SEQ ID NO: 673 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group via dipeptide spacer
HXQGTFTSDKSKYLDEQAAKEFIAWLMNT

SEQ ID NO: 674 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via acidic amino acid spacer
HXQGTFTSDKSKYLDEQAAKEFIAWLMNT

SEQ ID NO: 675 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
HXQGTFTSDKSKYLDEQAAKEFIAWLMNT

SEQ ID NO: 676 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
HXEGTFTSDKSKYLDEQAAKEFIAWLMNT

SEQ ID NO: 677 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via acidic amino acid spacer
HXQGTFISDKSKYLDEQAAKEFIAWLMNT

SEQ ID NO: 678 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
HXQGTFISDKSKYLDEQAAKEFIAWLMNT

SEQ ID NO: 679 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via acidic amino acid spacer
  MISC_FEATURE (16)..(20): Lactam ring between side chains of amino acids at positions 16 and 20
XSQGTFTSDKSKYLDERRAKDFVQWLMNT

SEQ ID NO: 680 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via dipeptide spacer
  MISC_FEATURE (16)..(20): Lactam ring between side chains of amino acids at positions 16 and 20
XSQGTFTSDKSKYLDERRAKDFVQWLMNT

SEQ ID NO: 681 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via acidic amino acid spacer
XSQGTFTSDYSKYLDERRAKDFVQWLMNK

SEQ ID NO: 682 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via dipeptide spacer
XSQGTFTSDYSKYLDERRAKDFVQWLMNK

SEQ ID NO: 683 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
  MOD_RES (16)..(16): Xaa is Aib
HXQGTFTSDKSKYLDXRAAQDFVQWLMDT

SEQ ID NO: 684 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via acidic amino acid spacer
  MOD_RES (16)..(16): Xaa is Aib
HXQGTFTSDKSKYLDXRAAQDFVQWLMDT

SEQ ID NO: 685 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERRAQDFVQWLMNT

SEQ ID NO: 686 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERRAKDFVQWLMNT

SEQ ID NO: 687 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRRAEDFVQWLMNT

SEQ ID NO: 688 - protein, 29 aa, Artificial Sequence
  Synthetic Polypeptide
  MOD_RES (1)..(1): (Des-amino)His
  MISC_FEATURE (29)..(29): c-term amidation
XSQGTFTSDYSKYLDERAAKDFVQWLMNT

SEQ ID NO: 689 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERAAKDFVQWLMNT

SEQ ID NO: 690 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAQDFVQWLMNT

SEQ ID NO: 691 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAKDFVQWLMNT

SEQ ID NO: 692 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRAAEDFVQWLMNT

SEQ ID NO: 693 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLMNT

SEQ ID NO: 694-698 - skipped (5 entries)

SEQ ID NO: 699 - protein, 29 aa, Artificial Sequence
  Glucagon analog
  MOD_RES (29)..(29): C-terminal amidation
HSQGTFTSDYSKYLDERRAQDFVQWLMNT

SEQ ID NO: 700 - protein, 31 aa, Artificial Sequence
  GLP-1 analog
HAEGTFTSDVSSYLEEQAAREFIAWLVRGRG

SEQ ID NO: 701 - protein, 29 aa, Homo sapiens
  MOD_RES (29)..(29): C-terminal amidation
HSQGTFTSDYSKYLDSRRAQDFVQWLMNT

SEQ ID NO: 702 - protein, 24 aa, Artificial Sequence
  Glucagon analog
  MOD_RES (1)..(1): N-terminal amino group replaced with hydroxy group
FTSDYSKYLDSRRAQDFVQWLMNT

SEQ ID NO: 703 - protein, 31 aa, Homo sapiens
HAEGTFTSDVSSYLEGQAAKEFIAWLVKGRG

SEQ ID NO: 704 - protein, 30 aa, Homo sapiens
  MOD_RES (30)..(30): AMIDATION
HAEGTFTSDVSSYLEGQAAKEFIAWLVKGR

SEQ ID NO: 705 - protein, 28 aa, Homo sapiens
HGEGTFTSDLSKQMEEAVRLFIEWLKNG

SEQ ID NO: 706 - protein, 37 aa, Homo sapiens
HSQGTFTSDYSKYLDSRRAQDFVQWLMDTKRNRNNIA

SEQ ID NO: 707 - protein, 42 aa, Homo sapiens
YAEGTFISDYSIAMDKIHQQDFVNWLLAQKGKKNDWKHNITQ

SEQ ID NO: 708 - protein, 33 aa, Homo sapiens
HADGSFSDEMNTILDNLAARDFINWLIQTKITD

SEQ ID NO: 709 - protein, 49 aa, Homo sapiens
YLYQWLGAPVPYPDPLEPRREVCELNPDCDELADHIGFQEAYRRFYGPV

SEQ ID NO: 710 - protein, 10 aa, Artificial Sequence
  peptide fragment representing the carboxy terminal 10 amino acids of Exendin-4
GPSSGAPPPS

SEQ ID NO: 711 - protein, 10 aa, Artificial Sequence
  peptide fragment representing the carboxy terminal 10 amino acids of Exendin-4
  MOD_RES (10)..(10): AMIDATION
GPSSGAPPPS

SEQ ID NO: 712 - protein, 11 aa, Artificial Sequence
  peptide fragment representing the carboxy terminal 10 amino acids of Exendin-4
  MOD_RES (11)..(11): Pegylation
GPSSGAPPPSC

SEQ ID NO: 713 - protein, 13 aa, Artificial Sequence
  peptide fragment representing the carboxy terminal 13 amino acids of GIP peptide
KGKKNDWKHNITQ

SEQ ID NO: 714 - protein, 8 aa, Artificial Sequence
  peptide fragment representing the carboxy terminal 8 amino acids of oxyntomodulin
KRNRNNIA

SEQ ID NO: 715 - protein, 6 aa, Artificial Sequence
  Glucagon analogue
  MOD_RES (6)..(6): C-terminal amide
HTRGTF

SEQ ID NO: 716 - protein, 6 aa, Artificial Sequence
  glucagon analogue
  MOD_RES (1)..(1): d-histidine
  MOD_RES (2)..(2): d-threonine
  MOD_RES (3)..(3): d-arginine
  MOD_RES (5)..(5): d-threonine
  MOD_RES (6)..(6): d-phenylalanine
  MOD_RES (6)..(6): C-terminal amidation
XXXGXX

SEQ ID NO: 717 - protein, 30 aa, Artificial Sequence
  glucagon analogue
  MOD_RES (24)..(24): pegylation
HAEGTFTSDVSSYLEGQAAKEFICWLVKGR

SEQ ID NO: 718 - protein, 39 aa, Heloderma suspectum
HGEGTFTSDLSKQMEEEAVRLFIEWLKNGGPSSGAPPPS

SEQ ID NO: 719 - protein, 29 aa, Homo sapiens
YADAIFTNSYRKVLGQLSARKLLQDIMSR

SEQ ID NO: 720 - protein, 28 aa, Homo sapiens
  MOD_RES (28)..(28): AMIDATION
HSDAVFTDNYTRLRKQMAVKKYLNSILN

SEQ ID NO: 721 - protein, 27 aa, Homo sapiens
HSDGIFTDSYSRYRKQMAVKKYLAAVL

SEQ ID NO: 722 - protein, 27 aa, Homo sapiens
  MOD_RES (27)..(27): AMIDATION
HADGVFTSDFSKLLGQLSAKKYLESLM

SEQ ID NO: 723 - protein, 27 aa, Homo sapiens
  MOD_RES (27)..(27): AMIDATION
HSDGTFTSELSRLREGARLQRLLQGLV

SEQ ID NO: 724 - protein, 30 aa, Artificial Sequence
  Synthetic peptide
  MOD_RES (2)..(2): Xaa is AIB
  MOD_RES (24)..(24): Cys residue linked to 40kDa PEG via maleimide
  MOD_RES (30)..(30): C-terminal amidation
HXQGTFTSDYSKYLDEQAAKEFICWLMNTN

SEQ ID NO: 725 - protein, 29 aa, Artificial Sequence
  Synthetic peptide
  MOD_RES (2)..(2): Xaa is AIB
  MISC_FEATURE (24)..(24): Covalently bound to 40K PEG via thioether
  MOD_RES (29)..(29): AMIDATION
HXEGTFTSDYSKYLDEQAAKEFICWLMNT

SEQ ID NO: 726 - protein, 31 aa, Artificial Sequence
  Synthetic peptide
  MOD_RES (1)..(1): d-lysine
  MOD_RES (2)..(2): Sarcosine (N-methyl glycine)
  MOD_RES (4)..(4): Xaa is AIB
  MOD_RES (24)..(24): Covalently bound to 40kDa PEG via thioether
  MOD_RES (31)..(31): AMIDATION
KGHXEGTFTSDYSKYLDEQAAKEFICWLMNT

SEQ ID NO: 727 - protein, 31 aa, Artificial Sequence; identical to SEQ ID NO: 726
  Synthetic peptide
  MOD_RES (1)..(1): d-lysine
  MOD_RES (2)..(2): N-hexyl-glycine
  MOD_RES (4)..(4): Xaa is AIB
  MOD_RES (24)..(24): Covalently bound to 40kDa PEG via maleimide
  MOD_RES (31)..(31): AMIDATION

SEQ ID NO: 728 - protein, 31 aa, Artificial Sequence
  Synthetic peptide
  MOD_RES (1)..(1): d-lysine
  MOD_RES (2)..(2): N-methyl phenylalanine
  MOD_RES (4)..(4): Xaa is AIB
  MOD_RES (24)..(24): Covalently bound to 40kDa PEG via thioether
  MOD_RES (31)..(31): AMIDATION
KFHXEGTFTSDYSKYLDEQAAKEFICWLMNT

SEQ ID NO: 729 - protein, 29 aa, Artificial Sequence
  Synthetic peptide
  MOD_RES (2)..(2): Xaa is AIB
  MOD_RES (24)..(24): Covalently bound to 40 kDa PEG via maleimide
HXEGTFTSDYSKYLDEQAAKEFICWLMNT

SEQ ID NO: 730 - protein, 29 aa, Artificial Sequence
  Synthetic peptide
  MOD_RES (1)..(1): Xaa is DMIA
  MISC_FEATURE (16)..(20): Lactam ring between side chains of amino acids
  MOD_RES (24)..(24): Covalently bound to 40kDa PEG via maleimide
  MOD_RES (29)..(29): C-terminal amidation
XSQGTFTSDKSKYLDERRAKDFVCWLMNT

SEQ ID NO: 731 - protein, 30 aa, Artificial Sequence
  Synthetic peptide
  MOD_RES (30)..(30): C-terminal amidation
HSQGTFTSDYSKYLDEQAAKEFIAWLMNTN

SEQ ID NO: 732 - protein, 8 aa, Artificial Sequence
  Synthetic peptide
  MOD_RES (1)..(1): Xaa is Phe, hydroxyl-Phe, Gly, hydroxyl-Gly, Ala, Cys, Ser, Lys, Glu, dehydro-Val, Pro, d-Pro, AIB, 1-aminocyclohexanecarboxylic acid, 1-aminocyclopropanecarboxylic acid, N-Me-AIB, alpha-alpha-diethyl-Gly, hydroxyl-AIB, or d-Lys
  MOD_RES (2)..(2): Xaa is Pro, d-Pro, N-methyl-Gly, N-hexyl-Gly, Azetidine-2-carboxylic acid, N-methyl-Ala, or N-methyl-Phe
  MOD_RES (3)..(3): Xaa is His, d-His, Ala, or N-methyl-His
  MOD_RES (8)..(8): C-terminal amidation
XXXSRGTF

SEQ ID NO: 733 - protein, 31 aa, Artificial Sequence
  Synthetic peptide
  MOD_RES (1)..(1): d-Lys
  MOD_RES (2)..(2): Xaa is Sar
  MOD_RES (4)..(4): Xaa is AIB
  MOD_RES (26)..(26): Covalently bound to PEG via 40kDa maleimide
KXHXEGTFTSDYSKYLDEQAAKEFICWLMNT

SEQ ID NO: 734 - protein, 32 aa, Artificial Sequence
  Synthetic peptide
  MOD_RES (1)..(1): d-Lys
  MOD_RES (2)..(2): Xaa is Sar
  MOD_RES (4)..(4): Xaa is AIB
  MOD_RES (26)..(26): Cys residue linked to 40kDa PEG via maleimide
  MOD_RES (32)..(32): C-terminal amidation
KXHXQGTFTSDYSKYLDEQAAKEFICWLMNTN

SEQ ID NO: 735 - protein, 31 aa, Artificial Sequence
  Synthetic peptide
  MOD_RES (1)..(1): d-Lys
  MOD_RES (2)..(2): Xaa is Sar
  MOD_RES (3)..(3): Xaa is DMIA
  MISC_FEATURE (18)..(22): Lactam ring between side chains of amino acids
  MOD_RES (26)..(26): Covalently bound to 40kDa PEG via maleimide
  MOD_RES (31)..(31): C-terminal amidation
KXXSQGTFTSDKSKYLDERRAKDFVCWLMNT

SEQ ID NO: 736 - protein, 31 aa, Artificial Sequence; identical to SEQ ID NO: 726
  Synthetic peptide
  MOD_RES (1)..(1): d-Lys
  MOD_RES (2)..(2): N-hexyl-Gly
  MOD_RES (4)..(4): Xaa is AIB
  MISC_FEATURE (26)..(26): Covalently bound to 40K PEG via thioether
  MOD_RES (31)..(31): AMIDATION

SEQ ID NO: 737 - protein, 32 aa, Artificial Sequence
  Synthetic peptide
  MOD_RES (1)..(1): d-Lys
  MOD_RES (2)..(2): N-hexyl-Gly
  MOD_RES (4)..(4): Xaa is AIB
  MOD_RES (26)..(26): Cys residue linked to 40kDa PEG via maleimide
  MOD_RES (32)..(32): C-terminal amidation
KGHXQGTFTSDYSKYLDEQAAKEFICWLMNTN

SEQ ID NO: 738 - protein, 31 aa, Artificial Sequence
  Synthetic peptide
  MOD_RES (1)..(1): d-Lys
  MOD_RES (2)..(2): N-hexyl-Gly
  MOD_RES (3)..(3): Xaa is DMIA
  MISC_FEATURE (18)..(22): Lactam ring between side chains of amino acids
  MOD_RES (26)..(26): Covalently bound to 40kDa PEG via maleimide
  MOD_RES (31)..(31): C-terminal amidation
KGXSQGTFTSDKSKYLDERRAKDFVCWLMNT

SEQ ID NO: 739 - protein, 31 aa, Artificial Sequence; identical to SEQ ID NO: 728
  Synthetic peptide
  MOD_RES (1)..(1): d-Lys
  MOD_RES (2)..(2): N-methyl-Phe
  MOD_RES (4)..(4): Xaa is AIB
  MOD_RES (26)..(26): Covalently bound to 40kDa PEG via maleimide

SEQ ID NO: 740 - protein, 32 aa, Artificial Sequence
  Synthetic peptide
  MOD_RES (1)..(1): d-Lys
  MOD_RES (2)..(2): N-methyl-Phe
  MOD_RES (4)..(4): Xaa is AIB
  MOD_RES (26)..(26): Cys residue linked to 40kDa PEG via maleimide
  MOD_RES (32)..(32): C-terminal amidation
KFHXQGTFTSDYSKYLDEQAAKEFICWLMNTN

SEQ ID NO: 741 - protein, 31 aa, Artificial Sequence
  Synthetic peptide
  MOD_RES (1)..(1): d-Lys
  MOD_RES (2)..(2): N-methyl-Phe
  MOD_RES (3)..(3): Xaa is DMIA
  MISC_FEATURE (18)..(22): Lactam ring between side chains of amino acids
  MOD_RES (26)..(26): Covalently bound to 40kDa PEG via maleimide
  MOD_RES (31)..(31): C-terminal amidation
KFXSQGTFTSDKSKYLDERRAKDFVCWLMNT

SEQ ID NO: 742 - protein, 29 aa, Artificial Sequence
  Synthetic peptide
  MOD_RES (2)..(2): Xaa is AIB
  MOD_RES (24)..(24): Pegylated
  MOD_RES (29)..(29): C-terminal amidation
HXEGTFTSDYSKYLDEQAAKEFICWLMNT

SEQ ID NO: 743 - protein, 29 aa, Artificial Sequence
  Synthetic peptide
  MOD_RES (2)..(2): Xaa is AIB
  MOD_RES (10)..(10): Acylated with fatty acyl group
  MOD_RES (16)..(16): Xaa is AIB
  MOD_RES (29)..(29): C-terminal amidation
HXQGTFTSDKSKYLDXRAAQDFVQWLMDT

SEQ ID NO: 744 - protein, 40 aa, Artificial Sequence
  Synthetic peptide
  MOD_RES (2)..(2): Xaa is AIB
  MOD_RES (40)..(40): C-terminal amidation
HXEGTFTSDVSSYLEEQAAKEFIAWLVKGGPSSGAPPPSK

SEQ ID NO: 745 - protein, 29 aa, Artificial Sequence
  Synthetic peptide
  MOD_RES (1)..(1): Xaa is Dmia
  MISC_FEATURE (16)..(20): Lactam ring between side chains of amino acids at positions 16 and 20
  MOD_RES (24)..(24): Pegylated
  MOD_RES (29)..(29): C-terminal amidation
XSQGTFTSDYSKYLDERRAKDFVCWLMNT

SEQ ID NO: 746 - protein, 29 aa, Artificial Sequence
  Synthetic peptide
  MOD_RES (2)..(2): d-Ser
  MISC_FEATURE (16)..(20): Lactam ring between side chains of amino acids at positions 16 and 20
  MOD_RES (24)..(24): Pegylated
  MOD_RES (29)..(29): C-terminal amidation
HSQGTFTSDYSLYLDERAAKDFVCWLLDT

SEQ ID NO: 747 - protein, 29 aa, Artificial Sequence
  Synthetic peptide
  MOD_RES (2)..(2): Xaa is AIB
  MOD_RES (16)..(16): Xaa is AIB
  MOD_RES (20)..(20): Xaa is AIB
  MOD_RES (24)..(24): Pegylated
  MOD_RES (29)..(29): C-terminal amidation
HXQGTFTSDYSKYLDXKRAXEFVCWLLDT

SEQ ID NO: 748 - protein, 29 aa, Artificial Sequence
  Synthetic peptide
  MOD_RES (2)..(2): Xaa is AIB
  MOD_RES (10)..(10): Acylated with fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 749 - protein, 29 aa, Artificial Sequence
  Synthetic peptide
  MOD_RES (2)..(2): Xaa is AIB
  MOD_RES (10)..(10): Acylated with fatty acyl group via acidic amino acid spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 750 - protein, 29 aa, Artificial Sequence
  Synthetic peptide
  MOD_RES (2)..(2): d-Ser
  MOD_RES (10)..(10): Acylated with fatty acyl group via dipeptide spacer
  MOD_RES (16)..(16): Xaa is AIB
  MOD_RES (29)..(29): C-terminal amidation
HSQGTFTSDKSKYLDXRAAQDFVQWLMDT

SEQ ID NO: 751 - protein, 29 aa, Artificial Sequence
  Synthetic peptide
  MOD_RES (2)..(2): Xaa is AIB
  MOD_RES (10)..(10): Acylated with fatty acyl group via dipeptide spacer
  MOD_RES (16)..(16): Xaa is AIB
  MOD_RES (29)..(29): C-terminal amidation
HXQGTFTSDKSKYLDXRAAQDFVQWLLDT

SEQ ID NO: 752 - protein, 29 aa, Artificial Sequence
  Synthetic peptide
  MOD_RES (2)..(2): Xaa is AIB
  MOD_RES (10)..(10): Acylated with fatty acyl group via dipeptide spacer
  MOD_RES (29)..(29): C-terminal amidation
HXQGTFTSDKSKYLDERAAQDFVQWLMDT

SEQ ID NO: 753 - protein, 29 aa, Artificial Sequence
  Synthetic peptide
  MOD_RES (2)..(2): Xaa is AIB
  MOD_RES (10)..(10): Acylated with fatty acyl group via dipeptide spacer
  MOD_RES (16)..(16): Xaa is AIB
  MOD_RES (29)..(29): C-terminal amidation
HXQGTFTSDKSKYLEXRAAQDFVQWLMDT

SEQ ID NO: 754 - protein, 29 aa, Artificial Sequence
  Synthetic peptide
  MOD_RES (2)..(2): d-Ser
  MOD_RES (10)..(10): Acylated with fatty acyl group via acidic amino acid spacer
  MOD_RES (29)..(29): C-terminal amidation
HSQGTFTSDKSKYLDERAAQDFVQWLLDT

SEQ ID NO: 755 - protein, 29 aa, Artificial Sequence
  Synthetic peptide
  MOD_RES (2)..(2): Xaa is AIB
  MOD_RES (10)..(10): Acylated with fatty acyl group via acidic amino acid spacer
  MOD_RES (29)..(29): C-terminal amidation
HXQGTFTSDKSKYLDEQAAKEFIAWLLDT

SEQ ID NO: 756 - protein, 40 aa, Artificial Sequence
  Synthetic polypeptide
  MOD_RES (2)..(2): Xaa is Aib
  MOD_RES (20)..(20): Xaa is Aib
  MOD_RES (40)..(40): C-terminal amidation
YXEGTFTSDYSIYLDKQAAXEFVNWLLAGGPSSGAPPPSK

SEQ ID NO: 757 - protein, 39 aa, Artificial Sequence
  Synthetic polypeptide
  MOD_RES (2)..(2): Xaa is Aib
  MOD_RES (20)..(20): Xaa is Aib
  MOD_RES (39)..(39): C-terminal amidation
YXEGTFTSDYSIYLDKQAAXEFVNWLLAGGPSSGAPPPS

SEQ ID NO: 758 - protein, 39 aa, Artificial Sequence
  Synthetic polypeptide
  MOD_RES (2)..(2): Xaa is Aib
  MOD_RES (10)..(10): Acylated with fatty acyl group via dipeptide spacer
  MOD_RES (20)..(20): Xaa is AIB
  MOD_RES (39)..(39): C-terminal amidation
YXEGTFTSDKSIYLDKQAAXEFVNWLLAGGPSSGAPPPS

SEQ ID NO: 759 - protein, 40 aa, Artificial Sequence
  Synthetic polypeptide
  MOD_RES (2)..(2): Xaa is AIB
  MOD_RES (20)..(20): Xaa is AIB
  MOD_RES (24)..(24): Pegylated
  MOD_RES (40)..(40): C-terminal amidation
YXEGTFTSDYSIYLDKQAAXEFVCWLLAGGPSSGAPPPSK

SEQ ID NO: 760 - protein, 40 aa, Artificial Sequence
  Synthetic polypeptide
  MOD_RES (2)..(2): Xaa is AIB
  MOD_RES (20)..(20): Xaa is AIB
  MOD_RES (40)..(40): Pegylated
  MOD_RES (40)..(40): C-terminal amidation
YXEGTFTSDYSIYLDKQAAXEFVNWLLAGGPSSGAPPPSC

SEQ ID NO: 761 - protein, 40 aa, Artificial sequence
  Synthetic polypeptide
  MOD_RES (2)..(2): Xaa is AIB
  MISC_FEATURE (16)..(20): Lactam bridge between side chains of amino acids at positions 16 and 20
  MOD_RES (40)..(40): Pegylated
  MOD_RES (40)..(40): C-terminal amidation
YXEGTFTSDYSIYLDEQAAKEFVNWLLAGGPSSGAPPPSC

SEQ ID NO: 762 - protein, 40 aa, Artificial Sequence; identical to SEQ ID NO: 760
  Synthetic polypeptide
  MOD_RES (2)..(2): Xaa is AIB
  MOD_RES (20)..(20): Xaa is AIB
  MOD_RES (40)..(40): Pegylated
  MOD_RES (40)..(40): C-terminal amidation

SEQ ID NO: 763 - protein, 40 aa, Artificial Sequence; identical to SEQ ID NO: 759
  Synthetic polypeptide
  MOD_RES (2)..(2): Xaa is AIB
  MOD_RES (20)..(20): Xaa is AIB
  MOD_RES (24)..(24): Pegylated
  MOD_RES (40)..(40): C-terminal amidation

SEQ ID NO: 764 - protein, 40 aa, Artificial Sequence; identical to SEQ ID NO: 756
  Synthetic polypeptide
  MOD_RES (2)..(2): Xaa is AIB
  MOD_RES (20)..(20): Xaa is AIB
  MOD_RES (40)..(40): Acylated with fatty acyl group
  MOD_RES (40)..(40): C-terminal amidation

SEQ ID NO: 765 - protein, 40 aa, Artificial Sequence
  Synthetic polypeptide
  MOD_RES (2)..(2): Xaa is AIB
  MOD_RES (10)..(10): Acylated with fatty acyl group via dipeptide spacer
  MOD_RES (20)..(20): Xaa is AIB
  MOD_RES (40)..(40): C-terminal amidation
YXEGTFTSDKSIYLDKQAAXEFVNWLLAGGPSSGAPPPSK

SEQ ID NO: 766 - protein, 40 aa, Artificial Sequence
  Synthetic polypeptide
  MOD_RES (2)..(2): Xaa is AIB
  MOD_RES (20)..(20): Xaa is AIB
  MOD_RES (24)..(24): Pegylated
  MOD_RES (40)..(40): C-terminal amidation
YXQGTFTSDYSIYLDKQAAXEFVCWLLAGGPSSGAPPPSK

SEQ ID NO: 767 - protein, 29 aa, Artificial Sequence
  Synthetic peptide
  MOD_RES (3)..(3): Xaa is Acetyldiaminobutanoic acid
  MOD_RES (16)..(16): Xaa is AIB
  MOD_RES (29)..(29): C-terminal amidation
HSXGTFTSDYSKYLDXRRAADFVAWLLDE

SEQ ID NO: 768 - protein, 29 aa, Artificial Sequence
  Synthetic peptide
  MOD_RES (3)..(3): Xaa is Acetyldiaminobutanoic acid
  MOD_RES (16)..(16): Xaa is AIB
  MOD_RES (29)..(29): C-terminal amidation
HSXGTFTSDYSKYLDXERAADFVAWLLDE

SEQ ID NO: 769 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (26)..(26): Pegylated
  MOD_RES (31)..(31): C-terminal amidation
XXHXEGTFTSDYSKYLDEQAAKEFICWLMNT

SEQ ID NO: 770 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group
  MOD_RES (18)..(18): Xaa is AIB
  MOD_RES (31)..(31): C-terminal amidation
XXHXQGTFTSDKSKYLDXRAAQDFVQWLMDT

SEQ ID NO: 771 - protein, 42 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (42)..(42): C-terminal amidation
XXHXEGTFTSDVSSYLEEQAAKEFIAWLVKGGPSSGAPPPSK

SEQ ID NO: 772 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): d-Ser
  MISC_FEATURE (18)..(22): Lactam ring between side chains of amino acids at positions 18 and 22
  MOD_RES (26)..(26): Pegylated
  MOD_RES (31)..(31): C-terminal amidation
XXHSQGTFTSDYSLYLDERAAKDFVCWLLDT

SEQ ID NO: 773 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (18)..(18): Xaa is AIB
  MOD_RES (22)..(22): Xaa is AIB
  MOD_RES (26)..(26): Pegylated
  MOD_RES (31)..(31): C-terminal amidation
XXHXQGTFTSDYSKYLDXKRAXEFVCWLLDT

SEQ ID NO: 774 - protein, 31 aa, Artificial Sequence; identical to SEQ ID NO: 770
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (18)..(18): Xaa is AIB
  MOD_RES (31)..(31): C-terminal amidation

SEQ ID NO: 775 - protein, 31 aa, Artificial Sequence; identical to SEQ ID NO: 770
  Synthetic peptide
  MOD_RES (1)..(1): Xaa is AIB, d-Cys, d-Lys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via acidic amino acid spacer
  MOD_RES (18)..(18): Xaa is AIB
  MOD_RES (31)..(31): C-terminal amidation

SEQ ID NO: 776 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): d-Ser
  MOD_RES (12)..(12): Acylated with fatty acyl group via dipeptide spacer
  MOD_RES (18)..(18): Xaa is AIB
  MOD_RES (31)..(31): C-terminal amidation
XXHSQGTFTSDKSKYLDXRAAQDFVQWLMDT

SEQ ID NO: 777 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (18)..(18): Xaa is AIB
  MOD_RES (31)..(31): C-terminal amidation
XXHXQGTFTSDKSKYLDXRAAQDFVQWLLDT

SEQ ID NO: 778 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (31)..(31): C-terminal amidation
XXHXQGTFTSDKSKYLDERAAQDFVQWLMDT

SEQ ID NO: 779 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (18)..(18): Xaa is AIB
  MOD_RES (31)..(31): C-terminal amidation
XXHXQGTFTSDKSKYLEXRAAQDFVQWLMDT

SEQ ID NO: 780 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): d-Ser
  MOD_RES (12)..(12): Acylated with fatty acyl group via acidic amino acid spacer
  MOD_RES (31)..(31): C-terminal amidation
XXHSQGTFTSDKSKYLDERAAQDFVQWLLDT

SEQ ID NO: 781 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via acidic amino acid spacer
  MOD_RES (31)..(31): C-terminal amidation
XXHXQGTFTSDKSKYLDEQAAKEFIAWLLDT

SEQ ID NO: 782 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is Aib
  MOD_RES (22)..(22): Xaa is Aib
  MOD_RES (42)..(42): C-terminal amidation
XXYXEGTFTSDYSIYLDKQAAXEFVNWLLAGGPSSGAPPPSK

SEQ ID NO: 783 - protein, 41 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is Aib
  MOD_RES (22)..(22): Xaa is Aib
  MOD_RES (41)..(41): C-terminal amidation
XXYXEGTFTSDYSIYLDKQAAXEFVNWLLAGGPSSGAPPPS

SEQ ID NO: 784 - protein, 41 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is Aib
  MOD_RES (12)..(12): Acylated with fatty acyl group via dipeptide spacer
  MOD_RES (22)..(22): Xaa is AIB
  MOD_RES (41)..(41): C-terminal amidation
XXYXEGTFTSDKSIYLDKQAAXEFVNWLLAGGPSSGAPPPS

SEQ ID NO: 785 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (26)..(26): Pegylated
  MOD_RES (42)..(42): C-terminal amidation
XXYXEGTFTSDYSIYLDKQAAXEFVCWLLAGGPSSGAPPPSK

SEQ ID NO: 786 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (42)..(42): Pegylated
  MOD_RES (42)..(42): C-terminal amidation
XXYXEGTFTSDYSIYLDKQAAXEFVNWLLAGGPSSGAPPPSC

SEQ ID NO: 787 - protein, 42 aa, Artificial sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MISC_FEATURE (18)..(22): Lactam bridge between side chains of amino acids at positions 18 and 22
  MOD_RES (42)..(42): Pegylated
  MOD_RES (42)..(42): C-terminal amidation
XXYXEGTFTSDYSIYLDEQAAKEFVNWLLAGGPSSGAPPPSC

SEQ ID NO: 788 - protein, 42 aa, Artificial Sequence; identical to SEQ ID NO: 786
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (42)..(42): Pegylated
  MOD_RES (42)..(42): C-terminal amidation

SEQ ID NO: 789 - protein, 42 aa, Artificial Sequence; identical to SEQ ID NO: 785
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (26)..(26): Pegylated
  MOD_RES (42)..(42): C-terminal amidation

SEQ ID NO: 790 - protein, 42 aa, Artificial Sequence; identical to SEQ ID NO: 782
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (42)..(42): Acylated with fatty acyl group
  MOD_RES (42)..(42): C-terminal amidation

SEQ ID NO: 791 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (22)..(22): Xaa is AIB
  MOD_RES (42)..(42): C-terminal amidation
XXYXEGTFTSDKSIYLDKQAAXEFVNWLLAGGPSSGAPPPSK

SEQ ID NO: 792 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (26)..(26): Pegylated
  MOD_RES (42)..(42): C-terminal amidation
XXYXQGTFTSDYSIYLDKQAAXEFVCWLLAGGPSSGAPPPSK

SEQ ID NO: 793 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (5)..(5): Xaa is Acetyldiaminobutanoic acid
  MOD_RES (18)..(18): Xaa is AIB
  MOD_RES (31)..(31): C-terminal amidation
XXHSXGTFTSDYSKYLDXRRAADFVAWLLDE

SEQ ID NO: 794 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (5)..(5): Xaa is Acetyldiaminobutanoic acid
  MOD_RES (18)..(18): Xaa is AIB
  MOD_RES (31)..(31): C-terminal amidation
XXHSXGTFTSDYSKYLDXERAADFVAWLLDE

SEQ ID NO: 795-800 - skipped (6 entries)

SEQ ID NO: 801 - protein, 29 aa, Homo sapiens
HSQGTFTSDYSKYLDSRRAQDFVQWLMNT

SEQ ID NO: 802 - protein, 29 aa, Artificial Sequence
  Glucagon analogue
  MOD_RES (16)..(16): Xaa is Ser, Cys, Orn, homocysteine or acetyl phenyalanine
  MOD_RES (27)..(27): Xaa is Met, Leu or Nle
HSQGTFTSDYSKYLDXRRAQDFVQWLXDT

SEQ ID NO: 803 - protein, 29 aa, Artificial Sequence
  Glucagon analogue
  MOD_RES (17)..(17): Xaa is Arg, Cys, Orn, homocysteine or acetyl phenyalanine
  MOD_RES (27)..(27): Xaa is Met, Leu or Nle
HSQGTFTSDYSKYLDSXRAQDFVQWLXDT

SEQ ID NO: 804 - protein, 29 aa, Artificial Sequence
  Glucagon analogue
  MOD_RES (21)..(21): Xaa is Asp, Cys, Orn, homocysteine or acetyl phenylalanine
  MOD_RES (27)..(27): Xaa is Met, Leu or Nle
HSQGTFTSDYSKYLDSRRAQXFVQWLXDT

SEQ ID NO: 805 - protein, 29 aa, Artificial Sequence
  Synthetic peptide
  MOD_RES (24)..(24): Xaa is Gln, Cys, Orn, homocysteine or acetyl phenylalanine
  MOD_RES (27)..(27): Xaa is Met, Leu or Nle
HSQGTFTSDYSKYLDSRRAQDFVXWLXDT

SEQ ID NO: 806 - protein, 29 aa, Artificial Sequence
  Glucagon analogue
  MOD_RES (21)..(21): Xaa is Asp, Cys, Orn, homocysteine or acetyl phenyalanine
  MOD_RES (24)..(24): Xaa is Gln, Cys, Orn, homocysteine or acetyl phenyalanine
  MOD_RES (27)..(27): Xaa is Met, Leu or Nle
HSQGTFTSDYSKYLDSRRAQXFVXWLXDT

SEQ ID NO: 807 - protein, 29 aa, Artificial Sequence
  Glucagon analogue
  MOD_RES (27)..(27): Xaa is Met, Leu or Nle
  MOD_RES (28)..(28): Xaa is Lys, Arg, His, Asp, Glu, cysteic acid or homocysteic acid
  MOD_RES (29)..(29): Xaa is Thr, Lys, Arg, His, Asp, Glu, cysteic acid or homocysteic acid
HSQGTFTSDYSKYLDSRRAQDFVQWLXXX

SEQ ID NO: 808 - protein, 29 aa, Artificial Sequence
  Glucagon analogue
  MOD_RES (27)..(27): Xaa is Met, Leu or Nle
  MOD_RES (28)..(28): Xaa is Asp or Glu
  MOD_RES (29)..(29): Xaa is Thr, Asp or Glu
HSQGTFTSDYSKYLDSRRAQDFVQWLXXX

SEQ ID NO: 809 - protein, 29 aa, Artificial Sequence
  Glucagon analogue
  MOD_RES (27)..(27): Xaa is Met, Leu or Nle
  MOD_RES (29)..(29): Xaa is Asp or Glu
HSQGTFTSDYSKYLDSRRAQDFVQWLXNX

SEQ ID NO: 810 - protein, 29 aa, Artificial Sequence
  Synthetic peptide
  MOD_RES (27)..(27): Xaa is Met, Leu or Nle
HSQGTFTSDYSKYLDSRRAQDFVQWLXDT

SEQ ID NO: 811 - protein, 29 aa, Artificial Sequence
  Glucagon analogue
HSQGTFTSDYSKYLDSRRAQDFVQWLMDT

SEQ ID NO: 812 - protein, 29 aa, Artificial Sequence
  Glucagon analogue
  MOD_RES (29)..(29): Xaa is Lys, Arg or His
HSQGTFTSDYSKYLDSRRAQDFVQWLMNX

SEQ ID NO: 813 - protein, 29 aa, Artificial Sequence
  Glucagon analogue
HSQGTFTSDYSKYLESRRAQDFVQWLMDT

SEQ ID NO: 814 - protein, 29 aa, Artificial Sequence
  Synthetic peptide
  MOD_RES (16)..(16): Pegylation
  MOD_RES (27)..(27): Xaa is Met, Leu or Nle
HSQGTFTSDYSKYLDCRRAQDFVQWLXDT

SEQ ID NO: 815 - protein, 29 aa, Artificial Sequence
  Glucagon analogue
  MOD_RES (17)..(17): Pegylation
  MOD_RES (27)..(27): Xaa is Met, Leu or Nle
HSQGTFTSDYSKYLDSCRAQDFVQWLXDT

SEQ ID NO: 816 - protein, 29 aa, Artificial Sequence
  Glucagon analogue
  MOD_RES (21)..(21): Pegylation
  MOD_RES (27)..(27): Xaa is Met, Leu or Nle
HSQGTFTSDYSKYLDSRRAQCFVQWLXDT

SEQ ID NO: 817 - protein, 29 aa, Artificial Sequence
  Glucagon analogue
  MOD_RES (24)..(24): Pegylation
  MOD_RES (27)..(27): Xaa is Met, Leu or Nle
HSQGTFTSDYSKYLDSRRAQDFVCWLXDT

SEQ ID NO: 818 - protein, 29 aa, Artificial Sequence
  Glucagon analogue
  MOD_RES (21)..(21): Pegylation
  MOD_RES (27)..(27): Xaa is Met, Leu or Nle
HSQGTFTSDYSRYLDSRRAQKFVQWLXDT

SEQ ID NO: 819 - protein, 29 aa, Artificial Sequence
  Glucagon analogue
  MOD_RES (24)..(24): Pegylation
  MOD_RES (27)..(27): Xaa is Met, Leu or Nle
HSQGTFTSDYSRYLDSRRAQDFVKWLXDT

SEQ ID NO: 820 - protein, 10 aa, Artificial Sequence
  Synthetic peptide
  MISC_FEATURE: Peptide fragment representing carboxy terminal 10 amino acids of Exendin-4
GPSSGAPPPS

SEQ ID NO: 821 - protein, 8 aa, Artificial Sequence
  Synthetic peptide
  MISC_FEATURE: Peptide fragment representing the carboxy terminal 8 amino acids of oxyntomodulin
KRNRNNIA

SEQ ID NO: 822 - protein, 4 aa, Artificial Sequence
  Synthetic peptide
  MISC_FEATURE: Peptide fragment representing the amino 4 amino acids of oxyntomodulin carboxy terminus of SEQ ID NO: 21
KRNR

SEQ ID NO: 823 - protein, 10 aa, Artificial Sequence
  Synthetic peptide
  MISC_FEATURE: Peptide fragment representing the carboxy terminal 10 amino acids of Exendin-4
  MOD_RES (10)..(10): AMIDATION
GPSSGAPPPS

SEQ ID NO: 824 - protein, 39 aa, Artificial Sequence
  Glucagon analogue
HSQGTFTSDYSKYLDSRRAQDFVQWLMDTGPSSGAPPPS

SEQ ID NO: 825 - protein, 37 aa, Artificial Sequence; identical to SEQ ID NO: 706
  Glucagon analogue

SEQ ID NO: 826 - protein, 33 aa, Artificial Sequence
  Glucagon analogue
HSQGTFTSDYSKYLDSRRAQDFVQWLMDTKRNR

SEQ ID NO: 827 - protein, 29 aa, Artificial Sequence
  Glucagon analogue
HSQGTFTSDYSKYLDSCRAQDFVQWLMNT

SEQ ID NO: 828 - protein, 39 aa, Artificial Sequence; identical to SEQ ID NO: 521
  Synthetic peptide

SEQ ID NO: 829 - protein, 29 aa, Artificial Sequence
  Glucagon analogue
  MOD_RES (24)..(24): 2-butyrolactone bound through Cys thiol group
HSQGTFTSDYSKYLDSRRAQDFVQWLMNT

SEQ ID NO: 830 - protein, 29 aa, Artificial Sequence
  Glucagon analogue
  MOD_RES (24)..(24): Carboxymethyl group bound through Cys thiol group
HSQGTFTSDYSKYLDSRRAQDFVQWLMNT

SEQ ID NO: 831 - protein, 39 aa, Artificial Sequence; identical to SEQ ID NO: 521
  Glucagon analogue

SEQ ID NO: 832 - protein, 30 aa, Artificial Sequence
  Glucagon analog
  MOD_RES (30)..(30): Xaa is Asp, Glu, Lys, Arg or His
HSQGTFTSDYSKYLDSRRAQDFVQWLMDTX

SEQ ID NO: 833 - protein, 29 aa, Artificial Sequence
  Glucagon analogue
  MOD_RES (15)..(15): Xaa is Asp, Glu, cysteic acid, homoglutamic acid or homocysteic acid
  MOD_RES (27)..(27): Xaa is Met, Leu or Nle
  MOD_RES (28)..(28): Xaa is Asn, Lys, Arg, His, Asp or Glu
  MOD_RES (29)..(29): Xaa is Thr, Lys, Arg, His, Asp or Glu
HSQGTFTSDYSKYLXSRRAQDFVQWLXXX

SEQ ID NO: 834 - protein, 29 aa, Artificial Sequence
  Glucagon analogue
  MOD_RES (15)..(15): Xaa is Asp, Glu, cysteic acid, homoglutamic acid or homocysteic acid
  MOD_RES (27)..(27): Xaa is Met, Leu or Nle
  MOD_RES (28)..(28): Xaa is Asn or an acidic amino acid
  MOD_RES (29)..(29): Xaa is Thr or an acidic amino acid
HSQGTFTSDYSKYLXSRRAQDFVQWLXXX

SEQ ID NO: 835 - protein, 39 aa, Artificial Sequence
  Synthetic peptide
HSQGTFTSDYSKYLDSRRAQDFVQWLMETGPSSGAPPPS

SEQ ID NO: 836 - protein, 37 aa, Artificial Sequence
  Glucagon analogue
HSQGTFTSDYSKYLDSRRAQDFVQWLMETKRNRNNIA

SEQ ID NO: 837 - protein, 33 aa, Artificial Sequence
  Glucagon analogue
HSQGTFTSDYSKYLDSRRAQDFVQWLMETKRNR

SEQ ID NO: 838 - protein, 29 aa, Artificial Sequence
  Glucagon analogue
HSQGTFTSDYSKYLDSRRAQDFVQWLMET

SEQ ID NO: 839 - protein, 27 aa, Artificial Sequence
  Synthetic peptide
  MOD_RES (1)..(1): Xaa is any amino acid
  MOD_RES (2)..(2): Xaa is any amino acid
  MOD_RES (27)..(27): Met comprises Z
XXQGTFTSDYSKYLDSRRAQDFVQWLM

SEQ ID NO: 840 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): Pegylation
XSQGTFTSDYSKYLDERRAKDFVCWLMNT

SEQ ID NO: 841 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): Glutamine to alanine mutation
  MOD_RES (29)..(29): Pegylation
XSQGTFTSDYSKYLDERRAKDFVAWLMNC

SEQ ID NO: 842 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): Pegylation
  MOD_RES (27)..(27): Xaa is Nle or Leu
XSQGTFTSDYSKYLDERRAKDFVCWLXNT

SEQ ID NO: 843 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MISC_FEATURE (24)..(24): Glutamine to alanine mutation
  MISC_FEATURE (27)..(27): Xaa is Nle or Leu
  MOD_RES (29)..(29): Pegylation
XSQGTFTSDYSKYLDERRAKDFVAWLXNC

SEQ ID NO: 844 - protein, 29 aa, Artificial Sequence
  Synthetic peptide
  MISC_FEATURE: SEQ ID NO: 1 with  Ala 20, Ala 24, Nle 27, and Asp 28
  MOD_RES (27)..(27): Xaa is Nle
HSQGTFTSDYSKYLDSRRAADFVAWLXDT

SEQ ID NO: 845 - protein, 29 aa, Artificial Sequence
  Synthetic peptide
  MISC_FEATURE: SEQ ID NO: 1 with Ala 20, Ala 24, Nle27 , Asp 28, and Glu 29
  MOD_RES (27)..(27): Xaa is Nle
HSQGTFTSDYSKYLDSRRAADFVAWLXDE

SEQ ID NO: 846 - protein, 30 aa, Artificial Sequence
  Synthetic peptide
  MISC_FEATURE: SEQ ID NO: 1 with Ala 20, Ala 24, Nle 27, Asp 28, and Glu 30
  MOD_RES (27)..(27): Xaa is Nle
HSQGTFTSDYSKYLDSRRAADFVAWLXDTE

SEQ ID NO: 847 - protein, 29 aa, Artificial Sequence
  Synthetic peptide
  MISC_FEATURE: SEQ ID NO: 1 with Ala 20, Ala 24, Nle 27, Glu 28, and Glu 29
  MOD_RES (27)..(27): Xaa is Nle
HSQGTFTSDYSKYLDSRRAADFVAWLXEE

SEQ ID NO: 848 - protein, 30 aa, Artificial Sequence
  Synthetic peptide
  MISC_FEATURE: SEQ ID NO: 1 with Ala 20, Ala 24, Nle 27, Glu 28, and Glu 30
  MOD_RES (27)..(27): Xaa is Nle
HSQGTFTSDYSKYLDSRRAADFVAWLXETE

SEQ ID NO: 849 - protein, 30 aa, Artificial Sequence
  Synthetic peptide
  MOD_RES (27)..(27): Xaa is Nle
  MISC_FEATURE (27)..(27): SEQ ID NO: 1 with Ala 20, Ala 24, Nle 27, Glu 29, and Glu 30
HSQGTFTSDYSKYLDSRRAADFVAWLXNEE

SEQ ID NO: 850 - protein, 29 aa, Artificial Sequence
  Synthetic peptide
  MISC_FEATURE: SEQ ID NO: 1 with Ala 20, Glu 21, Ala 24, Nle 27, and Asp 28
  MOD_RES (27)..(27): Xaa is Nle
HSQGTFTSDYSKYLDSRRAAEFVAWLXDT

SEQ ID NO: 851 - protein, 29 aa, Artificial Sequence
  Synthetic peptide
  MISC_FEATURE: SEQ ID NO: 1 with Ala 20, Glu 21, Ala 24, Nle 27, Asp 28, and Glu 29
  MOD_RES (27)..(27): Xaa is Nle
HSQGTFTSDYSKYLDSRRAAEFVAWLXDE

SEQ ID NO: 852 - protein, 29 aa, Artificial Sequence
  Synthetic peptide
  MISC_FEATURE: SEQ ID NO: 1 with Ala 20, Glu 21, Ala 24, Nle 27, Asp 28, and Glu 30
  MOD_RES (27)..(27): Xaa is Nle
HSQGTFTSDYSKYLDSRRAAEFVAWLXDE

SEQ ID NO: 853 - protein, 29 aa, Artificial Sequence
  Synthetic peptide
  MISC_FEATURE: SEQ ID NO :1 with Ala 20, Glu 21, Ala 24, Nle 27, Glu 28, and Glu 29
  MOD_RES (27)..(27): Xaa is Nle
HSQGTFTSDYSKYLDSRRAAEFVAWLXEE

SEQ ID NO: 854 - protein, 29 aa, Artificial Sequence
  Synthetic peptide
  MISC_FEATURE: SEQ ID NO: 1 with Ala 20, Glu 21, Ala 24, Nle 27, Glu 28, and Glu 30
HSQGTFTSDYSKYLDSRRAQDFVQWLMNT

SEQ ID NO: 855 - protein, 30 aa, Artificial Sequence
  Synthetic peptide
  MISC_FEATURE: SEQ ID NO: 1 with Ala 20, Glu 21, Ala 24, Nle 27, Glu 29, and Glu 30
  MOD_RES (27)..(27): Xaa is Nle
HSQGTFTSDYSKYLDSRRAAEFVAWLXNEE

SEQ ID NO: 856 - protein, 29 aa, Artificial Sequence
  Synthetic peptide
  MISC_FEATURE: SEQ ID NO: 1 with Thr 16, Ala 20, Glu 21, Ala 24, Nle 27, Asp 28, and Glu29
  MOD_RES (27)..(27): Xaa is Nle
HSQGTFTSDYSKYLDTRRAAEFVAWLXDE

SEQ ID NO: 857 - protein, 31 aa, Homo sapiens; identical to SEQ ID NO: 703

SEQ ID NO: 858 - protein, 30 aa, Homo sapiens; identical to SEQ ID NO: 704
  MOD_RES (30)..(30): AMIDATION

SEQ ID NO: 859 - protein, 29 aa, Artificial Sequence
  Synthetic peptide
  MOD_RES (3)..(3): Xaa is Glutamine analog
  MOD_RES (27)..(27): Xaa is Nle
HSXGTFTSDYSKYLDTRRAAEFVAWLXDE

SEQ ID NO: 860 - protein, 29 aa, Artificial Sequence
  Synthetic peptide
  MOD_RES (3)..(3): Xaa is Glutamine analog
  MOD_RES (16)..(16): Xaa is Aminoisobutryic acid
HSXGTFTSDYSKYLDXRRAADFVAWLMDE

SEQ ID NO: 861 - protein, 29 aa, Artificial Sequence
  Synthetic peptide
  MOD_RES (27)..(27): Xaa is Nle
HSQGTFTSDYSKYLDTRRAAEFVAWLXDE

SEQ ID NO: 862 - protein, 29 aa, Artificial Sequence
  Synthetic peptide
  MOD_RES (3)..(3): Xaa is Acetamidomethyl-cysteine
  MOD_RES (27)..(27): Xaa is Nle
HSXGTFTSDYSKYLDTRRAAEFVAWLXDE

SEQ ID NO: 863 - protein, 29 aa, Artificial Sequence
  Synethic peptide
  MOD_RES (3)..(3): Xaa is Acetyldiaminobutanoic acid
  MOD_RES (27)..(27): Xaa is Nle
HSXGTFTSDYSKYLDTRRAAEFVAWLXDE

SEQ ID NO: 864 - protein, 29 aa, Artificial Sequence
  Synthetic peptide
  MOD_RES (3)..(3): Xaa is Carbamoyldiaminopropanoic acid
  MOD_RES (27)..(27): Xaa is Nle
HSXGTFTSDYSKYLDTRRAAEFVAWLXDE

SEQ ID NO: 865 - protein, 29 aa, Artificial Sequence
  Synthetic peptide
  MOD_RES (3)..(3): Xaa is Methylglutamine
  MOD_RES (27)..(27): Xaa is Nle
HSXGTFTSDYSKYLDTRRAAEFVAWLXDE

SEQ ID NO: 866 - protein, 29 aa, Artificial Sequence
  Synthetic peptide
  MOD_RES (3)..(3): Xaa is Methionine sulfoxide
  MOD_RES (27)..(27): Xaa is Nle
HSXGTFTSDYSKYLDTRRAAEFVAWLXDE

SEQ ID NO: 867 - protein, 29 aa, Artificial Sequence
  Synthetic peptide
  MOD_RES (3)..(3): Xaa is Acetylornithine
  MOD_RES (27)..(27): Xaa is Nle
HSXGTFTSDYSKYLDTRRAAEFVAWLXDE

SEQ ID NO: 868 - protein, 29 aa, Artificial Sequence
  Synthetic peptide
  MOD_RES (16)..(16): Xaa is Aminoisobutryic acid
HSQGTFTSDYSKYLDXRRAADFVAWLMDE

SEQ ID NO: 869 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic acid
HSXGTFTSDYSKYLDXRRAADFVAWLMDE

SEQ ID NO: 870 - protein, 29 aa, Artificial Sequence
  Synthetic peptide
  MOD_RES (3)..(3): Xaa is Methylglutamine
  MOD_RES (16)..(16): Xaa is Aib
HSXGTFTSDYSKYLDXRRAADFVAWLMDE

SEQ ID NO: 871 - protein, 29 aa, Artificial Sequence
  Synthetic peptide
  MOD_RES (3)..(3): Xaa is acetyldiaminobutanoic acid
  MOD_RES (16)..(16): Xaa is Aib
HSXGTFTSDYSKYLDXRRAADFVAWLLDE

SEQ ID NO: 872 - protein, 39 aa, Artificial Sequence; identical to SEQ ID NO: 604
  Synthetic peptide
  MOD_RES (3)..(3): Xaa is Acetyldiaminobutanoic acid
  MOD_RES (16)..(16): Aminoisobutryic Acid
  MOD_RES (39)..(39): AMIDATION

SEQ ID NO: 873 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryric acid
HSXGTFTSDYSKYLDXRRASDFVSWLLDE

SEQ ID NO: 874 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic acid
HSXGTFTSDYSKYLDXRRATDFVTWLLDE

SEQ ID NO: 875 - protein, 29 aa, Artificial Sequence
  Synthetic peptide
HSQGTFTSDYSKYLDSRRAQDFVQWLMDE

SEQ ID NO: 876 - protein, 29 aa, Artificial Sequence
  Synthetic peptide
  MOD_RES (16)..(16): Xaa is Aib
HSQGTFTSDYSKYLDXRRAQDFVQWLMDE

SEQ ID NO: 877 - protein, 29 aa, Artificial Sequence
  Synthetic peptide
  misc_feature (3)..(3): Xaa can be any naturally occurring amino acid
HSXGTFTSDYSKYLDSRRAQDFVQWLMNT

SEQ ID NO: 878 - protein, 29 aa, Artificial Sequence
  Synthetic peptide
HSQGTFTSDYSKYLDSRRAQDFVQWLMDT

SEQ ID NO: 879 - protein, 30 aa, Artificial Sequence; identical to SEQ ID NO: 581
  Synthetic peptide
  MOD_RES (2)..(2): Xaa is d-Ser
  MOD_RES (30)..(30): Acylated with a C14 fatty acyl group
  MOD_RES (30)..(30): AMIDATION

SEQ ID NO: 880 - protein, 29 aa, Artificial Sequence
  Synthetic peptide
  MOD_RES (2)..(2): Xaa is d-Ser
  MOD_RES (10)..(10): Acylated with a C14 fatty acyl group
  MOD_RES (29)..(29): AMIDATION
HXQGTFTSDKSKYLDERRAKDFVQWLMNT

SEQ ID NO: 881 - protein, 30 aa, Artificial Sequence; identical to SEQ ID NO: 581
  Synthetic peptide
  MOD_RES (2)..(2): Xaa is d-Ser
  MOD_RES (30)..(30): Acylated with a C16 fatty acyl group
  MOD_RES (30)..(30): AMIDATION

SEQ ID NO: 882 - protein, 29 aa, Artificial Sequence
  Synthetic peptide
  MOD_RES (2)..(2): Xaa is d-Ser
  MOD_RES (10)..(10): Acylated with a C16 fatty acyl group
  MOD_RES (29)..(29): AMIDATION
HXQGTFTSDKSKYLDERRAKDFVQWLMNT

SEQ ID NO: 883 - protein, 29 aa, Artificial Sequence
  Synthetic peptide
  MOD_RES (2)..(2): Aminoisobutryic Acid
  MOD_RES (10)..(10): Acylated with a C18 fatty acyl group
  MOD_RES (24)..(24): Cys-PEG
  MOD_RES (29)..(29): AMIDATION
HXQGTFTSDKSKYLDEQAAKEFICWLMNT

SEQ ID NO: 884 - protein, 30 aa, Artificial Sequence; identical to SEQ ID NO: 586
  Synthetic peptide
  MOD_RES (2)..(2): Aminoisobutryic Acid
  MOD_RES (24)..(24): Cys-PEG
  MOD_RES (30)..(30): Acylated with a C18 fatty acyl group
  MOD_RES (30)..(30): AMIDATION

SEQ ID NO: 885 - protein, 29 aa, Artificial sequence
  Synthetic peptide
  MOD_RES (16)..(16): Xaa is Ser or alpha, alpha-disubstituted amino acid
  MOD_RES (20)..(20): Xaa is Gln or alpha, alpha-disubstituted amino acid
  MOD_RES (21)..(21): Xaa is Asp or alpha, alpha-disubstituted amino acid
  MOD_RES (24)..(24): Xaa is Gln or alpha, alpha-disubstituted amino acid
HSQGTFTSDYSKYLDXRRAXXFVXWLMNT

SEQ ID NO: 886 - protein, 29 aa, Artificial Sequence
  Synthetic peptide
  MOD_RES (16)..(16): Xaa is Aib
HSQGTFTSDYSKYLDXRRAQDFVQWLMNT

SEQ ID NO: 887 - protein, 29 aa, Artificial Sequence
  Synthetic peptide
  MOD_RES (19)..(19): Xaa is Aib
HSQGTFTSDYSKYLDSRRXQDFVQWLMNT

SEQ ID NO: 888 - protein, 29 aa, Artificial Sequence
  Synthetic peptide
  MOD_RES (20)..(20): Xaa is Aib
HSQGTFTSDYSKYLDSRRAXDFVQWLMNT

SEQ ID NO: 889 - protein, 29 aa, Artificial Sequence
  Synthetic peptide
  MOD_RES (21)..(21): Xaa is Aib
HSQGTFTSDYSKYLDSRRAQXFVQWLMNT

SEQ ID NO: 890 - protein, 29 aa, Artificial Sequence
  Synthetic peptide
  MOD_RES (24)..(24): Xaa is Aib
HSQGTFTSDYSKYLDSRRAQDFVXWLMNT

SEQ ID NO: 891 - protein, 29 aa, Artificial Sequence
  Synthetic peptide
  MOD_RES (16)..(16): Xaa is Aib
  MOD_RES (20)..(20): Xaa is Aib
HSQGTFTSDYSKYLDXRRAXDFVQWLMNT

SEQ ID NO: 892 - protein, 29 aa, Artificial Sequence
  Synthetic peptide
  MOD_RES (16)..(16): Xaa is Aib
  MOD_RES (24)..(24): Xaa is Aib
HSQGTFTSDYSKYLDXRRAQDFVXWLMNT

SEQ ID NO: 893 - protein, 29 aa, Artificial Sequence
  Synthetic peptide
  MOD_RES (20)..(20): Xaa is Aib
  MOD_RES (24)..(24): Xaa is Aib
HSQGTFTSDYSKYLDSRRAXDFVXWLMNT

SEQ ID NO: 894 - protein, 29 aa, Artificial Sequence
  Synthetic peptide
  MOD_RES (16)..(16): Xaa is Aib
  MOD_RES (20)..(20): Xaa is Aib
  MOD_RES (24)..(24): Xaa is Aib
HSQGTFTSDYSKYLDXRRAXDFVXWLMNT

SEQ ID NO: 895 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDKSKYLDXRRAQDFVQWLMNT

SEQ ID NO: 896 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDYSKYLDXRRAQDFVQWLMNT

SEQ ID NO: 897 - protein, 29 aa, Artificial Sequence
  Synthetic peptide
  MOD_RES (2)..(2): Xaa is Aib
  MOD_RES (10)..(10): Acylated with a C16 fatty acyl group
  MOD_RES (16)..(16): Xaa is Aib
  MOD_RES (29)..(29): AMIDATION
HXQGTFTSDKSKYLDXRRAQDFVQWLMNT

SEQ ID NO: 898 - protein, 29 aa, Artificial Sequence
  Synthetic peptide
  MOD_RES (2)..(2): Xaa is Aib
  MOD_RES (10)..(10): Acylated with a C16 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 899 - protein, 29 aa, Artificial Sequence
  Synthetic peptide
  MOD_RES (2)..(2): Xaa is Aib
  MOD_RES (10)..(10): Acylated with a C16 fatty acyl group via dipeptide spacer
  MOD_RES (16)..(16): Xaa is Aib
  MOD_RES (29)..(29): AMIDATION
HXQGTFTSDKSKYLDXRRAQDFVQWLMNT

SEQ ID NO: 900 - protein, 29 aa, Artificial Sequence
  Synthetic peptide
  MOD_RES (2)..(2): Xaa is Aib
  MOD_RES (10)..(10): Acylated with a C16 fatty acyl group via beta-Ala-beta-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 901 - protein, 29 aa, Artificial Sequence
  Synthetic peptide
  MOD_RES (2)..(2): Xaa is Aib
  MOD_RES (10)..(10): Acylated with a C16 fatty acyl group via 6-aminohexanoic acid spacer
  MOD_RES (16)..(16): Xaa is Aib
  MOD_RES (29)..(29): AMIDATION
HXQGTFTSDKSKYLDXRRAQDFVQWLMNT

SEQ ID NO: 902 - protein, 29 aa, Artificial Sequence
  Synthetic peptide
  MOD_RES (2)..(2): Xaa is Aib
  MOD_RES (10)..(10): Acylated with a C16 fatty acyl group via Leu-Leu spacer
  MOD_RES (16)..(16): Xaa is Aib
  MOD_RES (29)..(29): AMIDATION
HXQGTFTSDKSKYLDXRRAQDFVQWLMNT

SEQ ID NO: 903 - protein, 29 aa, Artificial Sequence
  Synthetic peptide
  MOD_RES (2)..(2): Xaa is Aib
  MOD_RES (10)..(10): Acylated with a C16 fatty acyl group via Pro-Pro spacer
  MOD_RES (16)..(16): Xaa is Aib
  MOD_RES (29)..(29): AMIDATION
HXQGTFTSDKSKYLDXRRAQDFVQWLMNT

SEQ ID NO: 904 - protein, 29 aa, Artificial Sequence
  Synthetic peptide
  MOD_RES (2)..(2): Xaa is Aib
  MOD_RES (10)..(10): Acylated with a C14 fatty acyl group
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 905 - protein, 29 aa, Artificial Sequence
  Synthetic peptide
  MOD_RES (2)..(2): Xaa is Aib
  MOD_RES (10)..(10): Acylated with a C14 fatty acyl group via dipeptide spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 906 - protein, 29 aa, Artificial Sequence
  Synthetic peptide
  MOD_RES (2)..(2): Xaa is Aib
  MOD_RES (10)..(10): Acylated with a C14 fatty acyl group via dipeptide spacer
  MOD_RES (16)..(16): Xaa is Aib
  MOD_RES (29)..(29): AMIDATION
HXQGTFTSDKSKYLDXRRAQDFVQWLMNT

SEQ ID NO: 907 - protein, 29 aa, Artificial Sequence
  Synthetic peptide
  MOD_RES (2)..(2): Xaa is Aib
  MOD_RES (10)..(10): Acylated with a C14 fatty acyl group via Ala-Ala spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 908 - protein, 29 aa, Artificial Sequence
  Synthetic peptide
  MOD_RES (2)..(2): Xaa is Aib
  MOD_RES (10)..(10): Acylated with a C14 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 909 - protein, 29 aa, Artificial Sequence
  Synthetic peptide
  MOD_RES (2)..(2): Xaa is Aib
  MOD_RES (10)..(10): Acylated with a C16 fatty acyl group via Ala-Ala spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 910 - protein, 29 aa, Artificial Sequence
  Synthetic peptide
  MOD_RES (2)..(2): Xaa is Aib
  MOD_RES (10)..(10): Acylated with a C16 fatty acyl group via dipeptide spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 911 - protein, 29 aa, Artificial Sequence
  Synthetic peptide
  MOD_RES (2)..(2): Xaa is Aib
  MOD_RES (10)..(10): Covalently bound to a C14 fatty acyl group
  MOD_RES (16)..(16): Xaa is Aib
  MOD_RES (29)..(29): AMIDATION
HXQGTFTSDKSKYLDXRRAQDFVCWLMNT

SEQ ID NO: 912 - protein, 29 aa, Artificial Sequence
  Synthetic peptide
  MOD_RES (2)..(2): Xaa is Aib
  MOD_RES (10)..(10): Covalently bound to C14 fatty acyl group via dipeptide spacer
  MOD_RES (16)..(16): Xaa is Aib
  MOD_RES (29)..(29): AMIDATION
HXQGTFTSDKSKYLDXRRAQDFVCWLMNT

SEQ ID NO: 913 - protein, 29 aa, Artificial Sequence
  Synthetic peptide
  MOD_RES (2)..(2): Xaa is Aib
  MOD_RES (10)..(10): Covalently bound to C14 fatty acyl group via Ala-Ala spacer
  MOD_RES (16)..(16): Xaa is Aib
  MOD_RES (29)..(29): AMIDATION
HXQGTFTSDKSKYLDXRRAQDFVCWLMNT

SEQ ID NO: 914 - protein, 29 aa, Artificial Sequence
  Synthetic peptide
  MOD_RES (2)..(2): Xaa is Aib
  MOD_RES (10)..(10): Covalently bound to C16 fatty acyl group via dipeptide spacer
  MOD_RES (16)..(16): Xaa is Aib
  MOD_RES (29)..(29): AMIDATION
HXQGTFTSDKSKYLDXRRAQDFVCWLMNT

SEQ ID NO: 915 - protein, 29 aa, Artificial Sequence
  Synthetic peptide
  MOD_RES (2)..(2): Xaa is Aib
  MOD_RES (10)..(10): Covelently bound to C16 fatty acyl group via Ala-Ala spacer
  MOD_RES (16)..(16): Xaa is Aib
  MOD_RES (29)..(29): AMIDATION
HXQGTFTSDKSKYLDXRRAQDFVCWLMNT

SEQ ID NO: 916 - protein, 30 aa, Artificial Sequence; identical to SEQ ID NO: 581
  Synthetic peptide
  MOD_RES (2)..(2): D-serine, D-alanine, valine, amino n-butyric acid, glycine, N-methyl serine, aminoisobutyric acid
  MOD_RES (30)..(30): Acylated with a C14 fatty acyl group
  MOD_RES (30)..(30): AMIDATION

SEQ ID NO: 917 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with a C14 fatty acyl group
  MOD_RES (29)..(29): AMIDATION
HXQGTFTSDKSKYLDERRAKDFVQWLMNT

SEQ ID NO: 918 - protein, 30 aa, Artificial Sequence; identical to SEQ ID NO: 581
  Synthetic peptide
  MOD_RES (2)..(2): D-serine, D-alanine, valine, amino n-butyric acid, glycine, N-methyl serine, aminoisobutyric acid
  MOD_RES (30)..(30): Acylated with a C16 fatty acyl group
  MOD_RES (30)..(30): AMIDATION

SEQ ID NO: 919 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group
  MOD_RES (29)..(29): AMIDATION
HXQGTFTSDKSKYLDERRAKDFVQWLMNT

SEQ ID NO: 920 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLMNT

SEQ ID NO: 921 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDEQAAKEFIAWLMNT

SEQ ID NO: 922 - protein, 29 aa, Artificial Sequence
  Synthetic Polypeptide
  MISC_FEATURE: c-term amidation
  MOD_RES (1)..(1): (Des-amino)His
XSQGTFTSDYSKYLDEQAAKEFIAWLVKG

SEQ ID NO: 923 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLVKG

SEQ ID NO: 924 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDEQAAKEFIAWLVKG

SEQ ID NO: 925 - protein, 29 aa, Artificial Sequence
  Synthetic Polypeptide
  MOD_RES (2)..(2): Aminoisobutyric acid
  MISC_FEATURE (29)..(29): c-term amidation
HXQGTFTSDYSKYLDERRAQDFVQWLMNT

SEQ ID NO: 926 - protein, 29 aa, Artificial Sequence
  Synthetic Polypeptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERRAKDFVQWLMNT

SEQ ID NO: 927 - protein, 29 aa, Artificial Sequence
  Synthetic Polypeptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERRAKDFVQWLMNT

SEQ ID NO: 928 - protein, 29 aa, Artificial Sequence
  Synthetic Polypeptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERRAQDFVQWLMNT

SEQ ID NO: 929 - protein, 29 aa, Artificial Sequence
  Synthetic Polypeptide
  MISC_FEATURE: c-term amidation
  MOD_RES (2)..(2): Aminoisebutyric acid
  MISC_FEATURE (12)..(16): Lactam ring between side chains at positions 12 and 16
HXQGTFTSDYSKYLDERRAKDFVQWLMNT

SEQ ID NO: 930 - protein, 29 aa, Artificial Sequence
  Synthetic Polypeptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDKRRAEDFVQWLMNT

SEQ ID NO: 931 - protein, 29 aa, Artificial Sequence
  Synthetic Polypeptide
  MISC_FEATURE: c-term amidation
  MOD_RES (2)..(2): Aminoisobutyric acid
HXQGTFTSDYSKYLDERAAKDFVQWLMNT

SEQ ID NO: 932 - protein, 29 aa, Artificial Sequence
  Synthetic Polypeptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERAAKDFVQWLMNT

SEQ ID NO: 933 - protein, 29 aa, Artificial Sequence
  Synthetic Polypeptide
  MISC_FEATURE: c-term amidation
  MOD_RES (2)..(2): Aminoisobutryic acid
  MISC_FEATURE (12)..(16): Lactam ring between side chains at positions 12 and 16
HXQGTFTSDYSKYLDERAAQDFVQWLMNT

SEQ ID NO: 934 - protein, 29 aa, Artificial Sequence
  glucagon analog
  MISC_FEATURE: c-term amidation
  MOD_RES (2)..(2): Aminoisobutryic acid
  MISC_FEATURE (12)..(16): Lactam ring between side chains at positions 12 and 16
HXQGTFTSDYSKYLDERAAKDFVQWLMNT

SEQ ID NO: 935 - protein, 29 aa, Artificial Sequence
  glucagon analog
  MISC_FEATURE: c-term amidation
  MOD_RES (2)..(2): Aminoisobutryic acid
  MISC_FEATURE (16)..(20): Lactam ring between side chains at positions 16 and 20
HXQGTFTSDYSKYLDKRAAEDFVQWLMNT

SEQ ID NO: 936 - protein, 29 aa, Artificial Sequence
  glucagon analog
  MISC_FEATURE: c-term amidation
  MOD_RES (2)..(2): Aminoisobutyric acid
HXQGTFTSDYSKYLDEQAAKEFIAWLMNT

SEQ ID NO: 937 - protein, 29 aa, Artificial Sequence
  glucagon analog
  MISC_FEATURE: c-term amidation
  MOD_RES (2)..(2): Aminoisobutryic acid
  MISC_FEATURE (12)..(16): Lactam ring between side chains at positions 12 and 16
HXQGTFTSDYSKYLDEQAAKEFIAWLMNT

SEQ ID NO: 938 - protein, 29 aa, Artificial Sequence
  glucagon analog
  MISC_FEATURE: c-term amidation
  MOD_RES (2)..(2): Aminoisobutryic acid
  MISC_FEATURE (16)..(20): Lactam ring between side chains at positions 16 and 20
HXQGTFTSDYSKYLDEQAAKEFIAWLMNT

SEQ ID NO: 939 - protein, 29 aa, Artificial Sequence
  glucagon analog
  MISC_FEATURE: c-term amidation
  MOD_RES (2)..(2): Aminoisobutyric acid
HXQGTFTSDYSKYLDEQAAKEFIAWLVKG

SEQ ID NO: 940 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDEQAAKEFIAWLVKG

SEQ ID NO: 941 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDEQAAKEFIAWLVKG

SEQ ID NO: 942 - protein, 29 aa, Artificial Sequence
  glucagon analog
  MISC_FEATURE: c-term amidation
  MOD_RES (2)..(2): D-Ala
HXQGTFTSDYSKYLDERRAQDFVQWLMNT

SEQ ID NO: 943 - protein, 29 aa, Artificial Sequence
  glucagon analog
  MISC_FEATURE: c-term amidation
  MOD_RES (2)..(2): D-Ala
HXQGTFTSDYSKYLDERRAKDFVQWLMNT

SEQ ID NO: 944 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERRAKDFVQWLMNT

SEQ ID NO: 945 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAQDFVQWLMNT

SEQ ID NO: 946 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAKDFVQWLMNT

SEQ ID NO: 947 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRRAEDFVQWLMNT

SEQ ID NO: 948 - protein, 29 aa, Artificial Sequence
  glucagon analog
  MISC_FEATURE: c-term amidation
  MOD_RES (2)..(2): D-Ala
HXQGTFTSDYSKYLDERAAKDFVQWLMNT

SEQ ID NO: 949 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERAAKDFVQWLMNT

SEQ ID NO: 950 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAQDFVQWLMNT

SEQ ID NO: 951 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAKDFVQWLMNT

SEQ ID NO: 952 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRAAEDFVQWLMNT

SEQ ID NO: 953 - protein, 29 aa, Artificial Sequence
  glucagon analog
  MISC_FEATURE: c-term amidation
  MOD_RES (2)..(2): D-Ala
HXQGTFTSDYSKYLDEQAAKEFIAWLMNT

SEQ ID NO: 954 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDEQAAKEFIAWLMNT

SEQ ID NO: 955 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDEQAAKEFIAWLMNT

SEQ ID NO: 956 - protein, 29 aa, Artificial Sequence
  glucagon analog
  MISC_FEATURE: c-term amidation
  MOD_RES (2)..(2): D-Ala
HXQGTFTSDYSKYLDEQAAKEFIAWLVKG

SEQ ID NO: 957 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDEQAAKEFIAWLVKG

SEQ ID NO: 958 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDEQAAKEFIAWLVKG

SEQ ID NO: 959 - protein, 29 aa, Artificial Sequence
  glucagon analog
  MISC_FEATURE: c-term amidation
HSEGTFTSDYSKYLDERRAQDFVQWLMNT

SEQ ID NO: 960 - protein, 29 aa, Artificial Sequence
  glucagon analog
  MISC_FEATURE: c-term amidation
HSEGTFTSDYSKYLDERRAKDFVQWLMNT

SEQ ID NO: 961 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDERRAKDFVQWLMNT

SEQ ID NO: 962 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDERRAQDFVQWLMNT

SEQ ID NO: 963 - protein, 29 aa, Artificial Sequence
  glucagon analog
  MISC_FEATURE: c-term amidation
HSEGTFTSDYSKYLDERAAKDFVQWLMNT

SEQ ID NO: 964 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDERAAKDFVQWLMNT

SEQ ID NO: 965-1000 - skipped (36 entries)

SEQ ID NO: 1001 - protein, 29 aa, Homo sapiens
  MISC_FEATURE: Wild type glucagon
HSQGTFTSDYSKYLDSRRAQDFVQWLMNT

SEQ ID NO: 1002 - protein, 31 aa, Homo sapiens; identical to SEQ ID NO: 703
  MISC_FEATURE (1)..(31): GLP-1(7-37)

SEQ ID NO: 1003 - protein, 30 aa, Artificial sequence; identical to SEQ ID NO: 704
  Synthetic polypeptide
  MISC_FEATURE (1)..(30): GLP-1(7-36) amidated
  MISC_FEATURE (30)..(30): C-terminal amidation

SEQ ID NO: 1004 - protein, 42 aa, Homo sapiens; identical to SEQ ID NO: 707
  mat_peptide (1)..(42): gastric inhibitory polypeptide

SEQ ID NO: 1005 - protein, 29 aa, Artificial sequence
  Synthetic polypeptide
  MISC_FEATURE: Analog 61
  MISC_FEATURE (16)..(20): Lactam bridge between residues 16 and 20.
HSQGTFTSDYSKYLDEIHQKEFIAWLMNT

SEQ ID NO: 1006 - protein, 29 aa, Artificial sequence
  Synthetic polypeptide
  MISC_FEATURE: Analog 62
  MISC_FEATURE (16)..(20): Lactam bridge between residues 16 and 20.
HSQGTFTSDYSIYLDEIHQKEFIAWLMNT

SEQ ID NO: 1007 - protein, 29 aa, Artificial sequence
  Synthetic polypeptide
  MISC_FEATURE: Analog 63
  MISC_FEATURE (12)..(16): Lactam bridge between residues 12 and 16.
HSQGTFTSDYSKYLDEIHQKEFIAWLMNT

SEQ ID NO: 1008 - protein, 29 aa, Artificial sequence
  Synthetic polypeptide
  MISC_FEATURE: Analog 66
HSQGTFTSDYSKYLDEIHQKEFIAWLLAQ

SEQ ID NO: 1009 - protein, 29 aa, Artificial sequence
  Synthetic polypeptide
  MISC_FEATURE: Analog 68
HSQGTFTSDYSKYLDKIHQEEFIAWLMNT

SEQ ID NO: 1010 - protein, 29 aa, Artificial sequence
  Synthetic polypeptide
  MISC_FEATURE: Analog 69
  MISC_FEATURE (16)..(20): Lactam bridge between residues 16 and 20
HSQGTFTSDYSKYLDKIHQEEFIAWLMNT

SEQ ID NO: 1011 - protein, 29 aa, Artificial sequence
  Synthetic polypeptide
  MISC_FEATURE: Analog 84
  MISC_FEATURE (16)..(20): Lactam bridge between residues 16 and 20
HSQGTFTSDYSIYLDEIHQKEFICWLLAQ

SEQ ID NO: 1012 - protein, 29 aa, Artificial sequence
  Synthetic polypeptide
  MISC_FEATURE: Analog 85
  MISC_FEATURE (16)..(20): Lactam bridge between residues 16 and 20
  MISC_FEATURE (24)..(24): PEG (20kDa) covalently attached to Cysteine
HSQGTFTSDYSIYLDEIHQKEFICWLLAQ

SEQ ID NO: 1013 - protein, 29 aa, Artificial sequence
  Synthetic polypeptide
  MISC_FEATURE: Analog 92
HSQGTFTSDYSIYLDEKHQKEFIAWLLAQ

SEQ ID NO: 1014 - protein, 29 aa, Artificial sequence
  Synthetic polypeptide
  MISC_FEATURE: Analog 93
  MISC_FEATURE (16)..(20): Lactam bridge between residues 16 and 20
  MISC_FEATURE (17)..(21): Lactam bridge between residues 17 and 21
HSQGTFTSDYSIYLDEKHQKEFIAWLLAQ

SEQ ID NO: 1015 - protein, 29 aa, Artificial sequence
  Synthetic polypeptide
  MISC_FEATURE: Analog 95
  MISC_FEATURE (16)..(20): Lactam bridge between residues 16 and 20
HAEGTFISDYSIAMDEIHQKDFVNWLLAQ

SEQ ID NO: 1016 - protein, 29 aa, Artificial sequence
  Synthetic polypeptide
  MISC_FEATURE: Analog 96
  MISC_FEATURE (16)..(20): Lactam bridge between residues 16 and 20
YAEGTFISDYSIAMDEIHQKDFVNWLLAQ

SEQ ID NO: 1017 - protein, 29 aa, Artificial sequence
  Synthetic polypeptide
  MISC_FEATURE: Analog 97
  MISC_FEATURE (16)..(20): Lactam bridge between residues 16 and 20
HAEGTFTSDYSIYMDEIHQKDFVNWLLAQ

SEQ ID NO: 1018 - protein, 29 aa, Artificial sequence
  Synthetic polypeptide
  MISC_FEATURE: Analog 98
  MISC_FEATURE (16)..(20): Lactam bridge between residues 16 and 20
YAEGTFTSDYSIYMDEIHQKDFVNWLLAQ

SEQ ID NO: 1019 - protein, 42 aa, Artificial sequence
  Synthetic polypeptide
  MISC_FEATURE: Analog 99
YAEGTFISDYSIAMDKIHQQDFVNWLLAQKGKKNWLKHNITQ

SEQ ID NO: 1020 - protein, 42 aa, Artificial sequence
  Synthetic polypeptide
  MISC_FEATURE: Analog 100
  MOD_RES (2)..(2): Xaa is Aib
YXEGTFISDYSIAMDKIHQQDFVNWLLAQKGKKNWLKHNITQ

SEQ ID NO: 1021 - protein, 42 aa, Artificial sequence
  Synthetic polypeptide
  MISC_FEATURE: Analog 101
YAPGTFISDYSIAMDKIHQQDFVNWLLAQKGKKNWLKHNITQ

SEQ ID NO: 1022 - protein, 42 aa, Artificial sequence
  Synthetic polypeptide
  MISC_FEATURE: Analog 102
  MOD_RES (2)..(2): Xaa is Aib
YXEGTFISDYSIAMDKIHQQDFVCWLLAQKGKKNWLKHNITQ

SEQ ID NO: 1023 - protein, 42 aa, Artificial sequence
  Synthetic polypeptide
  MISC_FEATURE: Analog 104
YAPGTFISDYSIAMDKIHQQDFVCWLLAQKGKKNWLKHNITQ

SEQ ID NO: 1024 - protein, 42 aa, Artificial sequence; identical to SEQ ID NO: 1023
  Synthetic polypeptide
  MISC_FEATURE: Analog 105
  MISC_FEATURE (24)..(24): PEG (40kDa) attached to Cysteine

SEQ ID NO: 1025 - protein, 29 aa, Artificial sequence
  Synthetic polypeptide
  MISC_FEATURE: Analog 106
YAEGTFISDYSIAMDKIHQQDFVNWLLAQ

SEQ ID NO: 1026 - protein, 29 aa, Artificial sequence
  Synthetic polypeptide
  MISC_FEATURE: Analog 107
  MISC_FEATURE (16)..(20): Lactam bridge between residues 16 and 20
HSQGTFISDYSKYLDEIHQKEFIAWLMNT

SEQ ID NO: 1027 - protein, 29 aa, Artificial sequence
  Synthetic polypeptide
  MISC_FEATURE: Analog 108
  MISC_FEATURE (16)..(20): Lactam bridge between residues 16 and 20
HSQGTFISDYSKALDEIHQKEFIAWLMNT

SEQ ID NO: 1028 - protein, 29 aa, Artificial sequence
  Synthetic polypeptide
  MISC_FEATURE: Analog 109
  MISC_FEATURE (16)..(20): Lactam bridge between residues 16 and 20
YSQGTFTSDYSKYLDEIHQKDFVNWLLAQ

SEQ ID NO: 1029 - protein, 29 aa, Artificial sequence
  Synthetic polypeptide
  MISC_FEATURE: Analog 110
  MISC_FEATURE (16)..(20): Lactam bridge between residues 16 and 20
YSQGTFTSDYSIYLDEIHQKDFVNWLLAQ

SEQ ID NO: 1030 - protein, 29 aa, Artificial sequence
  Synthetic polypeptide
  MISC_FEATURE: Analog 111
  MISC_FEATURE (16)..(20): Lactam bridge between residues 16 and 20
HSQGTFTSDYSKYLDEIHQKDFVNWLLAQ

SEQ ID NO: 1031 - protein, 24 aa, Artificial sequence
  Synthetic polypeptide
  MISC_FEATURE: Analog 113
  MOD_RES (1)..(1): Xaa is 3-phenyllactic acid
  MISC_FEATURE (11)..(15): Lactam bridge between residues 11 and 15
XISDYSIAMDEIHQKDFVNWLLAQ

SEQ ID NO: 1032 - protein, 24 aa, Artificial sequence
  Synthetic polypeptide
  MISC_FEATURE: Analog 114
  MOD_RES (1)..(1): Xaa is 3-phenyllactic acid
  MISC_FEATURE (11)..(15): Lactam bridge between residues 11 and 15
XTSDYSKYLDEIHQKDFVNWLLAQ

SEQ ID NO: 1033 - protein, 39 aa, Artificial sequence
  Synthetic polypeptide
  MISC_FEATURE: Analog 115
  MISC_FEATURE (16)..(20): Lactam bridge between residues 16 and 20
HSQGTFTSDYSKYLDEIHQKDFVNWLLAGGPSSGAPPPS

SEQ ID NO: 1034 - protein, 39 aa, Artificial sequence
  Synthetic polypeptide
  MISC_FEATURE: Analog 116
  MISC_FEATURE (16)..(20): Lactam bridge between residues 16 and 20
YSQGTFTSDYSKYLDEIHQKDFVNWLLAGGPSSGAPPPS

SEQ ID NO: 1035 - protein, 29 aa, Artificial sequence
  Synthetic polypeptide
  MISC_FEATURE: Analog 118
  MISC_FEATURE (16)..(20): Lactam bridge between residues 16 and 20
YSQGTFTSDYSKYLDEIHQKEFVNWLLAQ

SEQ ID NO: 1036 - protein, 39 aa, Artificial sequence
  Synthetic polypeptide
  MISC_FEATURE: Analog 120
  MISC_FEATURE (16)..(20): Lactam bridge between residues 16 and 20
YSQGTFTSDYSKYLDEQAAKEFIAWLMNGGPSSGAPPPS

SEQ ID NO: 1037 - protein, 29 aa, Artificial sequence
  Synthetic polypeptide
  MISC_FEATURE: Analog 124
  MISC_FEATURE (16)..(20): Lactam bridge between residues 16 and 20
HSQGTFTSDYSIYMDEIHQKDFVNWLLAQ

SEQ ID NO: 1038 - protein, 29 aa, Artificial sequence
  Synthetic polypeptide
  MISC_FEATURE: Analog 125
  MISC_FEATURE (16)..(20): Lactam bridge between residues 16 and 20
YSQGTFTSDYSIYMDEIHQKDFVNWLLAQ

SEQ ID NO: 1039 - protein, 39 aa, Artificial sequence
  Synthetic polypeptide
  MISC_FEATURE: Analog 127
  MISC_FEATURE (16)..(20): Lactam bridge between residues 16 and 20
YSQGTFTSDYSKYLDEQAAKEFVNWLLAGGPSSGAPPPS

SEQ ID NO: 1040 - protein, 39 aa, Artificial sequence
  Synthetic polypeptide
  MISC_FEATURE: Analog 128
  MISC_FEATURE (16)..(20): Lactam bridge between residues 16 and 20
HSQGTFTSDYSKYLDEIHQKDFIAWLMNGGPSSGAPPPS

SEQ ID NO: 1041 - protein, 39 aa, Artificial sequence
  Synthetic polypeptide
  MISC_FEATURE: Analog 129
  MISC_FEATURE (16)..(20): Lactam bridge between residues 16 and 20
YSQGTFTSDYSKYLDEIHQKDFIAWLMNGGPSSGAPPPS

SEQ ID NO: 1042 - protein, 39 aa, Artificial sequence
  Synthetic polypeptide
  MISC_FEATURE: Analog 139
  MISC_FEATURE (16)..(20): Lactam bridge between residues 16 and 20
YSQGTFTSDYSKYLDEQAAKEFIAWLLAGGPSSGAPPPS

SEQ ID NO: 1043 - protein, 39 aa, Artificial sequence
  Synthetic polypeptide
  MISC_FEATURE: Analog 140
  MISC_FEATURE (16)..(20): Lactam bridge between residues 16 and 20
YSQGTFTSDYSIYLDEQAAKEFVNWLLAGGPSSGAPPPS

SEQ ID NO: 1044 - protein, 39 aa, Artificial sequence
  Synthetic polypeptide
  MISC_FEATURE: Analog 141
  MISC_FEATURE (16)..(20): Lactam bridge between residuess 16 and 20
YSQGTFTSDYSKYMDEQAAKEFVNWLLAGGPSSGAPPPS

SEQ ID NO: 1045 - protein, 39 aa, Artificial sequence
  Synthetic polypeptide
  MISC_FEATURE: Analog 142
  MISC_FEATURE (16)..(20): Lactam bridge between residues 16 and 20
YAEGTFTSDYSIYMDEQAAKEFVNWLLAGGPSSGAPPPS

SEQ ID NO: 1046 - protein, 39 aa, Artificial sequence
  Synthetic polypeptide
  MISC_FEATURE: Analog 143
  MISC_FEATURE (16)..(20): Lactam bridge between residues 16 and 20
YSQGTFTSDYSKYLDERRAKEFVNWLLAGGPSSGAPPPS

SEQ ID NO: 1047 - protein, 39 aa, Artificial sequence
  Synthetic polypeptide
  MISC_FEATURE: Analog 144
  MISC_FEATURE (16)..(20): Lactam bridge between residues 16 and 20
YAQGTFTSDYSIYMDEQAAKEFVNWLLAGGPSSGAPPPS

SEQ ID NO: 1048 - protein, 39 aa, Artificial sequence
  Synthetic polypeptide
  MISC_FEATURE: Analog 145
  MISC_FEATURE (16)..(20): Lactam bridge between residues 16 and 20
YAQGTFISDYSKYLDEQAAKEFVNWLLAGGPSSGAPPPS

SEQ ID NO: 1049 - protein, 39 aa, Artificial sequence; identical to SEQ ID NO: 1048
  Synthetic polypeptide
  MISC_FEATURE: Analog 146
  MISC_FEATURE (16)..(20): Lactam bridge between residues 16 and 20

SEQ ID NO: 1050 - protein, 39 aa, Artificial sequence
  Synthetic polypeptide
  MISC_FEATURE: Analog 147
  MISC_FEATURE (16)..(20): Lactam bridge between residues 16 and 20
YSQGTFTSDYSIYLDEQAAKEFIAWLLAGGPSSGAPPPS

SEQ ID NO: 1051 - protein, 39 aa, Artificial sequence
  Synthetic polypeptide
  MISC_FEATURE: Analog 148
  MISC_FEATURE (16)..(20): Lactam bridge between residues 16 and 20
YSEGTFTSDYSIYLDEQAAKEFIAWLLAGGPSSGAPPPS

SEQ ID NO: 1052 - protein, 39 aa, Artificial sequence
  Synthetic polypeptide
  MISC_FEATURE: Analog 149
  MISC_FEATURE (16)..(20): Lactam bridge between residues 16 and 20
YAEGTFTSDYSIYLDEQAAKEFVNWLLAGGPSSGAPPPS

SEQ ID NO: 1053 - protein, 39 aa, Artificial sequence
  Synthetic polypeptide
  MISC_FEATURE: Analog 150
  MISC_FEATURE (16)..(20): Lactam bridge between residues 16 and 20
YSQGTFISDYSIYLDEQAAKEFVNWLLAGGPSSGAPPPS

SEQ ID NO: 1054 - protein, 39 aa, Artificial sequence; identical to SEQ ID NO: 1042
  Synthetic polypeptide
  MISC_FEATURE: Analog 151
  MISC_FEATURE (16)..(20): Lactam bridge between residues 16 and 20

SEQ ID NO: 1055 - protein, 39 aa, Artificial sequence
  Synthetic polypeptide
  MISC_FEATURE: Analog 152
  MOD_RES (2)..(2): Xaa is Aib
  MISC_FEATURE (16)..(20): Lactam bridge between residues 16 and 20
YXQGTFTSDYSIYLDEQAAKEFVNWLLAGGPSSGAPPPS

SEQ ID NO: 1056 - protein, 39 aa, Artificial sequence
  Synthetic polypeptide
  MISC_FEATURE: Analog 154
  MOD_RES (1)..(1): Xaa is hippuric acid
  MISC_FEATURE (16)..(20): Lactam bridge between residues 16 and 20
XSQGTFTSDYSIYLDEQAAKEFVNWLLAGGPSSGAPPPS

SEQ ID NO: 1057 - protein, 39 aa, Artificial sequence; identical to SEQ ID NO: 1039
  Synthetic polypeptide
  MISC_FEATURE: Analog 155
  MISC_FEATURE (12)..(16): Lactam bridge between residues 12 and 16

SEQ ID NO: 1058 - protein, 39 aa, Artificial sequence
  Synthetic polypeptide
  MISC_FEATURE: Analog 156
  MISC_FEATURE (20)..(24): Lactam bridge between residues 20 and 24
YSQGTFTSDYSIYLDEQAAKEFVEWLLAGGPSSGAPPPS

SEQ ID NO: 1059 - protein, 39 aa, Artificial sequence
  Synthetic polypeptide
  MISC_FEATURE: Analog 157
  MISC_FEATURE (24)..(28): Lactam bridge between residues 24 and 28
YSQGTFTSDYSIYLDEQAAKEFVEWLLKGGPSSGAPPPS

SEQ ID NO: 1060 - protein, 39 aa, Artificial sequence
  Synthetic polypeptide
  MISC_FEATURE: Analog 158
  MOD_RES (2)..(2): Xaa is Aib
  MISC_FEATURE (16)..(20): Lactam bridge between residues 16 and 20
YXQGTFTSDYSIYLDEQAAKEFVCWLLAGGPSSGAPPPS

SEQ ID NO: 1061 - protein, 39 aa, Artificial sequence
  Synthetic polypeptide
  MISC_FEATURE: Analog 162
  MOD_RES (2)..(2): Xaa is Aib
  MISC_FEATURE (16)..(20): Lactam bridge between residues 16 and 20
YXQGTFTSDYSYYLDEQAVKEFVNWLIAGGPSSGAPPPS

SEQ ID NO: 1062 - protein, 29 aa, Artificial sequence
  Synthetic polypeptide
  MISC_FEATURE: Analog 163
  MISC_FEATURE (16)..(20): Lactam bridge between residues 16 and 20
YSQGTFTSDYSIYLDEQAAKEFVNWLLAG

SEQ ID NO: 1063 - protein, 29 aa, Artificial sequence
  Synthetic polypeptide
  MISC_FEATURE: Analog 164
  MOD_RES (2)..(2): Xaa is Aib
  MISC_FEATURE (16)..(20): Lactam bridge between residues 16 and 20
YXQGTFTSDYSIYLDEQAAKEFVNWLLAG

SEQ ID NO: 1064 - protein, 40 aa, Artificial sequence
  Synthetic polypeptide
  MISC_FEATURE: Analog 165
  MOD_RES (2)..(2): Xaa is Aib
  MISC_FEATURE (16)..(20): Lactam bridge between residues 16 and 20
YXQGTFTSDYSIYLDEQAAKEFVNWLLAGGPSSGAPPPSC

SEQ ID NO: 1065 - protein, 40 aa, Artificial sequence; identical to SEQ ID NO: 1064
  Synthetic polypeptide
  MISC_FEATURE: Analog 166
  MOD_RES (2)..(2): Xaa is d-alanine
  MISC_FEATURE (16)..(20): Lactam bridge between residues 16 and 20

SEQ ID NO: 1066 - protein, 39 aa, Artificial sequence
  Synthetic polypeptide
  MISC_FEATURE: Analog 167
  MISC_FEATURE (17)..(20): Lactam bridge between residues 17 and 20
YSQGTFTSDYSIYLDEEAAKEFVNWLLAGGPSSGAPPPS

SEQ ID NO: 1067 - protein, 39 aa, Artificial sequence
  Synthetic polypeptide
  MISC_FEATURE: Analog 168
  MISC_FEATURE (18)..(21): Lactam bridge between residues 18 and 21
YSQGTFTSDYSIYLDEQKAKEFVNWLLAGGPSSGAPPPS

SEQ ID NO: 1068 - protein, 29 aa, Artificial sequence
  Synthetic polypeptide
  MISC_FEATURE: Analog 169
  MOD_RES (2)..(2): Xaa is Aib
  MISC_FEATURE (16)..(20): Lactam bridge between residues 16 and 20
YXQGTFTSDYSIYLDEQAAKEFVCWLLAG

SEQ ID NO: 1069 - protein, 40 aa, Artificial sequence; identical to SEQ ID NO: 1064
  Synthetic polypeptide
  MISC_FEATURE: Analog 170
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1070 - protein, 29 aa, Artificial sequence
  Synthetic polypeptide
  MISC_FEATURE: Analog 172
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFTSDYSIYLDEQAAKEFVCWLLAG

SEQ ID NO: 1071 - protein, 40 aa, Artificial sequence; identical to SEQ ID NO: 761
  Synthetic polypeptide
  MISC_FEATURE: Analog 174
  MOD_RES (2)..(2): Xaa is Aib
  MISC_FEATURE (16)..(20): Lactam bridge between residues 16 and 20

SEQ ID NO: 1072 - protein, 39 aa, Artificial sequence; identical to SEQ ID NO: 1060
  Synthetic polypeptide
  MISC_FEATURE: Analog 175
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine

SEQ ID NO: 1073 - protein, 40 aa, Artificial sequence
  Synthetic polypeptide
  MISC_FEATURE: Analog 176
  MOD_RES (2)..(2): Xaa is Aib
  MISC_FEATURE (16)..(20): Lactam bridge between residues 16 and 20
YXQGTFISDYSIYLDEQAAKEFVNWLLAGGPSSGAPPPSC

SEQ ID NO: 1074 - protein, 29 aa, Artificial sequence
  Synthetic polypeptide
  MISC_FEATURE: Analog 177
  MOD_RES (2)..(2): Xaa is Aib
  MISC_FEATURE (16)..(20): Lactam bridge between residues 16 and 20
YXQGTFISDYSIYLDEQAAKEFVCWLLAG

SEQ ID NO: 1075 - protein, 40 aa, Artificial sequence; identical to SEQ ID NO: 761
  Synthetic polypeptide
  MISC_FEATURE: Analog 178
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1076 - protein, 29 aa, Artificial sequence
  Synthetic polypeptide
  MISC_FEATURE: Analog 179
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFISDYSIYLDEQAAKEFVCWLLAG

SEQ ID NO: 1077 - protein, 40 aa, Artificial sequence; identical to SEQ ID NO: 1073
  Synthetic polypeptide
  MISC_FEATURE: Analog 182
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1078 - protein, 29 aa, Artificial sequence
  Synthetic polypeptide
  MISC_FEATURE: Analog 186
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFTSDYSIYLDEQAAKEFVCWLMNG

SEQ ID NO: 1079 - protein, 39 aa, Artificial sequence; identical to SEQ ID NO: 1055
  Synthetic polypeptide
  MISC_FEATURE: Analog 191
  MOD_RES (2)..(2): Xaa is Aib

SEQ ID NO: 1080 - protein, 34 aa, Artificial sequence
  Synthetic polypeptide
  MISC_FEATURE: Analog 192
FTSDYSIYLDEQAAKEFVNWLLAGGPSSGAPPPS

SEQ ID NO: 1081 - protein, 38 aa, Artificial sequence
  Synthetic polypeptide
  MISC_FEATURE: Analog 194
  MOD_RES (1)..(1): Xaa is Aib
XQGTFTSDYSIYLDEEAVRLFVNWLLAGGPSSGAPPPS

SEQ ID NO: 1082 - protein, 26 aa, Artificial sequence
  Synthetic polypeptide
  MISC_FEATURE: Analog 197
  MISC_FEATURE (13)..(17): Lactam bridge between residues 13 and 17
GTFTSDYSIYLDEQAAKEFVNWLLAG

SEQ ID NO: 1083 - protein, 28 aa, Artificial sequence
  Synthetic polypeptide
  MISC_FEATURE: Analog 198
  MOD_RES (1)..(1): Xaa is Aib
  MISC_FEATURE (15)..(19): Lactam bridge between residues 15 and 19
XQGTFTSDYSIYLDEQAAKEFVNWLLAG

SEQ ID NO: 1084 - protein, 40 aa, Artificial sequence
  Synthetic polypeptide
  MISC_FEATURE: Analog 199
  MOD_RES (2)..(2): Xaa is Aib
  MISC_FEATURE (16)..(20): Lactam bridge between residues 16 and 20
YXQGTFVSDYSIYLDEQAAKEFVNWLLAGGPSSGAPPPSC

SEQ ID NO: 1085 - protein, 40 aa, Artificial sequence
  Synthetic polypeptide
  MISC_FEATURE: Analog 200
  MOD_RES (2)..(2): Xaa is Aib
  MISC_FEATURE (16)..(20): Lactam bridge between residues 16 and 20
  MOD_RES (27)..(27): Xaa is Nle
YXQGTFTSDYSIYLDEQAAKEFVNWLXAGGPSSGAPPPSC

SEQ ID NO: 1086 - protein, 39 aa, Artificial sequence
  Synthetic polypeptide
  MISC_FEATURE: Analog 201
  MOD_RES (2)..(2): Xaa is Aib
YXQGTFTSDYSIYLDEEAVRLFVNWLLAGGPSSGAPPPS

SEQ ID NO: 1087 - protein, 40 aa, Artificial sequence; identical to SEQ ID NO: 1084
  Synthetic polypeptide
  MISC_FEATURE: Analog 202
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1088 - protein, 40 aa, Artificial sequence; identical to SEQ ID NO: 1085
  Synthetic polypeptide
  MISC_FEATURE: Analog 203
  MOD_RES (2)..(2): Xaa is Aib
  MISC_FEATURE (16)..(20): Lactam bridge between residues 16 and 20
  MOD_RES (27)..(27): Xaa is Nle
  MISC_FEATURE (40)..(40): PEG (40kDa) covalently attached to Cysteine

SEQ ID NO: 1089 - protein, 40 aa, Artificial sequence
  Synthetic polypeptide
  MISC_FEATURE: Analog 204
  MOD_RES (2)..(2): Xaa is Aib
  MISC_FEATURE (16)..(20): Lactam bridge between residues 16 and 20
YXEGTFTSDYSIYLDEQAAKEFVNWLLAGRPSSGAPPPSC

SEQ ID NO: 1090 - protein, 40 aa, Artificial sequence; identical to SEQ ID NO: 1089
  Synthetic polypeptide
  MISC_FEATURE: Analog 205
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1091 - protein, 43 aa, Artificial sequence
  Synthetic polypeptide
  MISC_FEATURE: Analog 206
  MOD_RES (2)..(2): Xaa is Aib
  MISC_FEATURE (16)..(20): Lactam bridge between residues 16 and 20
YXEGTFTSDYSIYLDEQAAKEFVNWLLAGKGKKNWLKHNITQC

SEQ ID NO: 1092 - protein, 43 aa, Artificial sequence
  Synthetic polypeptide
  MISC_FEATURE: Analog 207
  MOD_RES (2)..(2): Xaa is Aib
  MISC_FEATURE (16)..(20): Lactam bridge between residues 16 and 20
YXQGTFTSDYSIYLDEQAAKEFVNWLLAGKGKKNWLKHNITQC

SEQ ID NO: 1093 - protein, 43 aa, Artificial sequence; identical to SEQ ID NO: 1091
  Synthetic polypeptide
  MISC_FEATURE: Analog 208
  MOD_RES (2)..(2): Xaa is Aib
  MISC_FEATURE (16)..(20): Lactam bridge between residues 16 and 20
  MISC_FEATURE (43)..(43): PEG (40kDa) covalently attached to Cysteine

SEQ ID NO: 1094 - protein, 40 aa, Artificial sequence
  Synthetic polypeptide
  MISC_FEATURE: Analog 209
  MOD_RES (2)..(2): Xaa is Aib
  MISC_FEATURE (9)..(12): Lactam bridge between residues 9 and 12
  MISC_FEATURE (16)..(20): Lactam bridge between residues 16 and 20
YXQGTFTSEYSKYLDEQAAKEFVNWLLAGGPSSGAPPPSC

SEQ ID NO: 1095 - protein, 10 aa, Artificial sequence
  Synthetic polypeptide
  MISC_FEATURE: CEX
GPSSGAPPPS

SEQ ID NO: 1096 - protein, 11 aa, Artificial sequence
  Synthetic polypeptide
  MISC_FEATURE (1)..(1): Xaa is any amino acid
XGPSSGAPPPS

SEQ ID NO: 1097 - protein, 8 aa, Artificial sequence
  Synthetic polypeptide
KRNRNNIA

SEQ ID NO: 1098 - protein, 4 aa, Artificial sequence
  Synthetic polypeptide
KRNR

SEQ ID NO: 1099 - protein, 40 aa, Artificial Sequence; identical to SEQ ID NO: 760
  Synthetic polypeptide
  MOD_RES (2)..(2): Xaa is Aib
  MOD_RES (20)..(20): Xaa is Aib
  MISC_FEATURE (40)..(40): PEG (40kDa) covalently attached to Cysteine
  MISC_FEATURE (40)..(40): C-terminal amidation

SEQ ID NO: 1100 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 1101 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 1102 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached Lysine
  MISC_FEATURE (40)..(40): C-terminal amidation

SEQ ID NO: 1103 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 18 Carbon fatty acyl group covalently attached to Lysine
  MISC_FEATURE (40)..(40): C-terminal amidation

SEQ ID NO: 1104 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation

SEQ ID NO: 1105 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached Lysine
  MISC_FEATURE (40)..(40): C-terminal amidation

SEQ ID NO: 1106 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1107 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFTSDYSIYLDKQAAXEFVNWLLAGGPSSGAPPPSC

SEQ ID NO: 1108 - protein, 40 aa, Artificial Sequence; identical to SEQ ID NO: 1107
  Synthetic polypeptide
  MOD_RES (2)..(2): Xaa is Aib
  MOD_RES (20)..(20): Xaa is Aib
  MISC_FEATURE (40)..(40): PEG (40kDa) attached to Cysteine
  MISC_FEATURE (40)..(40): C-terminal amidation

SEQ ID NO: 1109 - protein, 40 aa, Artificial Sequence; identical to SEQ ID NO: 760
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1110 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDKQAAXEFVCWLLAG

SEQ ID NO: 1111 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1112 - protein, 29 aa, Artificial Sequence
  Synthetic polypeptide
  MISC_FEATURE (2)..(2): Xaa is Aib
  MISC_FEATURE (20)..(20): Xaa is Aib
YXQGTFTSDYSIYLDKQAAXEFVNWLLAG

SEQ ID NO: 1113 - protein, 39 aa, Artificial Sequence
  Synthetic polypeptide
  MOD_RES (2)..(2): Xaa is Aib
  MOD_RES (20)..(20): Xaa is Aib
  MISC_FEATURE (24)..(24): 14 Carbon fatty acyl group covalently attached to Lysine
  MISC_FEATURE (39)..(39): C-terminal amidation
YXEGTFTSDYSIYLDKQAAXEFVKWLLAGGPSSGAPPPS

SEQ ID NO: 1114 - protein, 39 aa, Artificial Sequence; identical to SEQ ID NO: 1113
  Synthetic polypeptide
  MOD_RES (2)..(2): Xaa is Aib
  MOD_RES (20)..(20): Xaa is Aib
  MISC_FEATURE (24)..(24): 16 Carbon fatty acyl group covalently attached to Lysine
  MISC_FEATURE (39)..(39): C-terminal amidation

SEQ ID NO: 1115 - protein, 39 aa, Artificial Sequence; identical to SEQ ID NO: 1113
  Synthetic polypeptide
  MOD_RES (2)..(2): Xaa is Aib
  MOD_RES (20)..(20): Xaa is Aib
  MISC_FEATURE (24)..(24): 18 Carbon fatty acyl group covalently attached to Lysine
  MISC_FEATURE (39)..(39): C-terminal amidation

SEQ ID NO: 1116 - protein, 39 aa, Artificial Sequence; identical to SEQ ID NO: 1113
  Synthetic polypeptide
  MOD_RES (2)..(2): Xaa is Aib
  MOD_RES (20)..(20): Xaa is Aib
  MISC_FEATURE (39)..(39): C-terminal amidation

SEQ ID NO: 1117 - protein, 39 aa, Artificial Sequence; identical to SEQ ID NO: 758
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (39)..(39): C-terminal amidation

SEQ ID NO: 1118 - protein, 39 aa, Artificial Sequence; identical to SEQ ID NO: 758
  Synthetic polypeptide
  MOD_RES (2)..(2): Xaa is Aib
  MISC_FEATURE (10)..(10): 16 Carbon fatty acyl group covalently attached to Lysine
  MOD_RES (20)..(20): Xaa is Aib
  MISC_FEATURE (39)..(39): C-terminal amidation

SEQ ID NO: 1119 - protein, 39 aa, Artificial Sequence; identical to SEQ ID NO: 758
  Synthetic polypeptide
  MOD_RES (2)..(2): Xaa is Aib
  MISC_FEATURE (10)..(10): 18 Carbon fatty acyl group covalently attached to Lysine
  MOD_RES (20)..(20): Xaa is Aib
  MISC_FEATURE (39)..(39): C-terminal amidation

SEQ ID NO: 1120 - protein, 39 aa, Artificial Sequence; identical to SEQ ID NO: 758
  Synthetic polypeptide
  MOD_RES (2)..(2): Xaa is Aib
  MOD_RES (20)..(20): Xaa is Aib
  MISC_FEATURE (39)..(39): C-terminal amidation

SEQ ID NO: 1121 - protein, 40 aa, Artificial Sequence
  Synthetic polypeptide
  MOD_RES (2)..(2): Xaa is Aib
  MOD_RES (16)..(16): Xaa is Orn
  MOD_RES (20)..(20): Xaa is Aib
  MISC_FEATURE (40)..(40): C-terminal amidation
YXQGTFTSDYSIYLDXQAAXEFVNWLLAGGPSSGAPPPSC

SEQ ID NO: 1122 - protein, 40 aa, Artificial Sequence; identical to SEQ ID NO: 1121
  Synthetic polypeptide
  MOD_RES (2)..(2): Xaa is Aib
  MOD_RES (16)..(16): Xaa is 2,4-diaminobutyric acid
  MOD_RES (20)..(20): Xaa is Aib
  MISC_FEATURE (40)..(40): C-terminal amidation

SEQ ID NO: 1123 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalentaly attached to Lysine
  MISC_FEATURE (40)..(40): C-terminal amidation
YXQGTFTSDYSIYLDKQAAXEFVNWLLAGGPSSGAPPPSK

SEQ ID NO: 1124 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 1125 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1126 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1127 - protein, 29 aa, Artificial Sequence
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (29)..(29): C-terminal amidation
YXQGTFTSDYSIYLDKQAAXEFVCWLLAG

SEQ ID NO: 1128 - protein, 29 aa, Artificial Sequence
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1129 - protein, 29 aa, Artificial Sequence
  Synthetic polypeptide
  MOD_RES (2)..(2): Xaa is Aib
  MISC_FEATURE (10)..(10): 16 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1130 - protein, 29 aa, Artificial Sequence
  Synthetic polypeptide
  MOD_RES (2)..(2): Xaa is Aib
  MISC_FEATURE (10)..(10): 18 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1131 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1132 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation

SEQ ID NO: 1133 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 1134 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1135 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1136 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached to Lysine
  MISC_FEATURE (40)..(40): C-terminal amidation

SEQ ID NO: 1137 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 1138 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 18 Carbon fatty acyl group covalently attached to Lysine
  MISC_FEATURE (40)..(40): C-terminal amidation

SEQ ID NO: 1139 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 1140 - protein, 40 aa, Artificial Sequence; identical to SEQ ID NO: 760
  Synthetic polypeptide
  MOD_RES (2)..(2): Xaa is Aib
  MOD_RES (20)..(20): Xaa is Aib
  MISC_FEATURE (40)..(40): PEG (40kDa) covalently attached to Cysteine
  MISC_FEATURE (40)..(40): C-terminal amidation

SEQ ID NO: 1141 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 1142 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation
YXQGTFTSDYSIYLDKQAAXEFVCWLMNGGPSSGAPPPSK

SEQ ID NO: 1143 - protein, 40 aa, Artificial Sequence; identical to SEQ ID NO: 1142
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 1144 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation

SEQ ID NO: 1145 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1146 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1147 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 3-SH-propionic acyl group covalently attached to Lysine
  MISC_FEATURE (40)..(40): C-terminal amidation

SEQ ID NO: 1148 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 1149 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFSSDYSIYLDKQAAXEFVNWLLAGGPSSGAPPPSC

SEQ ID NO: 1150 - protein, 40 aa, Artificial Sequence
  Synthetic polypeptide
  MOD_RES (2)..(2): Xaa is Aib
  MOD_RES (7)..(7): Xaa is 2-aminobutyric acid
  MOD_RES (20)..(20): Xaa is Aib
  MISC_FEATURE (40)..(40): C-terminal amidation
YXQGTFXSDYSIYLDKQAAXEFVNWLLAGGPSSGAPPPSC

SEQ ID NO: 1151 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 1152 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 1153 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 1154 - protein, 40 aa, Artificial Sequence
  Synthetic polypeptide
  MOD_RES (2)..(2): Xaa is Aib
  MOD_RES (20)..(20): Xaa is Aib
  MOD_RES (40)..(40): Xaa is d-Lysine
  MISC_FEATURE (40)..(40): 14 Carbon fatty acyl group covalently attached to d-Lysine
  MISC_FEATURE (40)..(40): C-terminal amidation
YXEGTFTSDYSIYLDKQAAXEFVCWLLAGGPSSGAPPPSX

SEQ ID NO: 1155 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MOD_RES (40)..(40): Xaa is d-Lysine
  MISC_FEATURE (40)..(40): C-terminal amidation

SEQ ID NO: 1156 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MOD_RES (40)..(40): Xaa is d-Lysine
  MISC_FEATURE (40)..(40): 14 Carbon fatty acyl group covalently attached to Lysine
  MISC_FEATURE (40)..(40): C-terminal amidation

SEQ ID NO: 1157 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): Xaa is d-Lysine
  MISC_FEATURE (40)..(40): C-terminal amidation

SEQ ID NO: 1158 - protein, 39 aa, Artificial Sequence
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (40)..(40): C-terminal amidation
YXEGTFTSDKSIYLDKQAAXEFVCWLLAGGPSSGAPPPS

SEQ ID NO: 1159 - protein, 39 aa, Artificial Sequence; identical to SEQ ID NO: 1158
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1160 - protein, 41 aa, Artificial Sequence
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (41)..(41): C-terminal amidation
YXEGTFTSDYSIYLDKQAAXEFVNWLLAGGPSSGAPPPSKC

SEQ ID NO: 1161 - protein, 41 aa, Artificial Sequence; identical to SEQ ID NO: 1160
  Synthetic polypeptide
  MOD_RES (2)..(2): Xaa is Aib
  MOD_RES (20)..(20): Xaa is Aib
  MISC_FEATURE (41)..(41): C-terminal amidation

SEQ ID NO: 1162 - protein, 39 aa, Artificial Sequence; identical to SEQ ID NO: 1158
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (24)..(24): PEG (40kDa) covalently attached to Cysteine
  MISC_FEATURE (39)..(39): C-terminal amidation

SEQ ID NO: 1163 - protein, 41 aa, Artificial Sequence; identical to SEQ ID NO: 1160
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (41)..(41): PEG (40kDa) covalently attached to Cysteine
  MISC_FEATURE (41)..(41): C-terminal amidation

SEQ ID NO: 1164 - protein, 41 aa, Artificial Sequence; identical to SEQ ID NO: 1160
  Synthetic polypeptide
  MOD_RES (2)..(2): Xaa is Aib
  MOD_RES (20)..(20): Xaa is Aib
  MISC_FEATURE (41)..(41): PEG (40kDa) covalently attached to Cysteine
  MISC_FEATURE (41)..(41): C-terminal amidation

SEQ ID NO: 1165 - protein, 40 aa, Artificial Sequence
  Synthetic polypeptide
  MOD_RES (2)..(2): Xaa is Aib
  MISC_FEATURE (40)..(40): 14 Carbon fatty acyl group covalently attached to Lysine
  MISC_FEATURE (40)..(40): C-terminal amidation
HXQGTFTSDYSKYLDEQAAKEFICWLMNGGPSSGAPPPSK

SEQ ID NO: 1166 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached to Lysine
  MISC_FEATURE (40)..(40): C-terminal amidation

SEQ ID NO: 1167 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): C-terminal amidation
YXQGTFTSDYSIYLDXQAAKEFVNWLLAGGPSSGAPPPSC

SEQ ID NO: 1168 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): C-terminal amidation
YXQGTFTSDYSIYLDXQAAQEFVNWLLAGGPSSGAPPPSC

SEQ ID NO: 1169 - protein, 40 aa, Artificial Sequence
  Synthetic polypeptide
  MOD_RES (2)..(2): Xaa is Aib
  MOD_RES (12)..(16): Lactam bridge between residues 12 and 16
  MOD_RES (20)..(20): Xaa is Aib
  MOD_RES (40)..(40): C-terminal amidation
YXQGTFTSDYSKYLDEQAAXEFVNWLLAGGPSSGAPPPSC

SEQ ID NO: 1170 - protein, 10 aa, Artificial Sequence
  Synthetic polypeptide
GPSSGAPPPK

SEQ ID NO: 1171 - protein, 11 aa, Artificial Sequence
  Synthetic polypeptide
  MOD_RES (1)..(1): Xaa is Gly or a small, aliphatic or non-polar or slightly polar amino acid
XGPSSGAPPPK

SEQ ID NO: 1172 - protein, 12 aa, Artificial Sequence
  Synthetic  polypeptide
  MOD_RES (1)..(1): Xaa is Gly or a small, aliphatic or non-polar or slightly polar amino acid
XGPSSGAPPPSK

SEQ ID NO: 1173 - protein, 40 aa, Artificial Sequence; identical to SEQ ID NO: 1167
  Synethic polypeptide
  MOD_RES (2)..(2): Xaa is Aib
  MOD_RES (16)..(16): Xaa is Aib
  MISC_FEATURE (40)..(40): PEG (40kDa) covalently attached to Cysteine
  MISC_FEATURE (40)..(40): C-terminal amidation

SEQ ID NO: 1174 - protein, 40 aa, Artificial Sequence; identical to SEQ ID NO: 1168
  Synthetic polypeptide
  MOD_RES (2)..(2): Xaa is Aib
  MOD_RES (16)..(16): Xaa is Aib
  MISC_FEATURE (40)..(40): PEG (40kDa) covalently attached to Cysteine
  MISC_FEATURE (40)..(40): C-terminal amidation

SEQ ID NO: 1175 - protein, 40 aa, Artificial Sequence; identical to SEQ ID NO: 1121
  Synthetic polypeptide
  MOD_RES (2)..(2): Xaa is Aib
  MOD_RES (16)..(16): Xaa is Aib
  MOD_RES (20)..(20): Xaa is Aib
  MISC_FEATURE (40)..(40): C-terminal amidation

SEQ ID NO: 1176 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFTSDYSIYLDEQAAXEFVNWLLAGGPSSGAPPPSC

SEQ ID NO: 1177 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDEQAAXEFVCWLLAG

SEQ ID NO: 1178 - protein, 29 aa, Artificial Sequence
  Synthetic polypeptide
  MISC_FEATURE: C-terminal amidation
  MOD_RES (2)..(2): Xaa is Aib
  MOD_RES (20)..(20): Xaa is Aib
YXQGTFTSDYSIYLDSQAAXEFVCWLLAG

SEQ ID NO: 1179 - protein, 30 aa, Artificial Sequene
  Synthetic polypeptide
  MOD_RES (2)..(2): Xaa is Aib
  MISC_FEATURE (24)..(24): PEG (40kDa) covalently attached to Cysteine
HXEGTFTSDVSSYLEEQAAKEFICWLVKGR

SEQ ID NO: 1180 - protein, 42 aa, Artificial Sequence
  Synthetic polypeptide
  MISC_FEATURE (24)..(24): Substituted amino acid covalently linked to hydrophilic group
YAPGTFISDYSIAMDKIHQQDFVXWLLAQKGKKNWLKHNITQ

SEQ ID NO: 1181 - protein, 40 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalentaly linked to hydrophilic group
YXQGTFTSDYSIYLDEQAAKEFVNWLLAGGPSSGAPPPSX

SEQ ID NO: 1182 - protein, 29 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
  misc_feature (29)..(29): Xaa can be any naturally occurring amino acid
YXQGTFTSDYSIYLDEQAAKEFVXWLLAX

SEQ ID NO: 1183 - protein, 39 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFTSDYSIYLDEQAAKEFVXWLLAGGPSSGAPPPS

SEQ ID NO: 1184 - protein, 40 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXEGTFTSDYSIYLDEQAAKEFVNWLLAGGPSSGAPPPSX

SEQ ID NO: 1185 - protein, 29 aa, Artificial Sequence
  Sythetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFISDYSIYLDEQAAKEFVXWLLAG

SEQ ID NO: 1186 - protein, 40 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXQGTFISDYSIYLDEQAAKEFVNWLLAGGPSSGAPPPSX

SEQ ID NO: 1187 - protein, 29 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFTSDYSIYLDEQAAKEFVXWLMNG

SEQ ID NO: 1188 - protein, 40 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substitute amino acid covalently linked to hydrophilic group
YXQGTFVSDYSIYLDEQAAKEFVNWLLAGGPSSGAPPPSX

SEQ ID NO: 1189 - protein, 40 aa, Artificial sequence
  Synthetic polypeptide
  MOD_RES (2)..(2): Xaa is Aib
  MISC_FEATURE (16)..(20): Lactam bridge between residues 16 and 20
  MOD_RES (27)..(27): Xaa is Nle
  MISC_FEATURE (40)..(40): Substituted amino acid covalently linked to hydrophilic group
YXQGTFTSDYSIYLDEQAAKEFVNWLXAGGPSSGAPPPSX

SEQ ID NO: 1190 - protein, 40 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXEGTFTSDYSIYLDEQAAKEFVNWLLAGRPSSGAPPPSX

SEQ ID NO: 1191 - protein, 43 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (43)..(43): Substituted amino acid covalently linked to hydrophilic group
YXEGTFTSDYSIYLDEQAAKEFVNWLLAGKGKKNWLKHNITQX

SEQ ID NO: 1192 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation
YXEGTFTSDYSIYLDKQAAXEFVNWLLAGGPSSGAPPPSX

SEQ ID NO: 1193 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation
YXEGTFTSDYSIYLDKQAAXEFVXWLLAGGPSSGAPPPSK

SEQ ID NO: 1194 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substitute amino acid covalently linked to an acyl or alkyl group
  MISC_FEATURE (40)..(40): C-terminal amidation
YXEGTFTSDYSIYLDKQAAXEFVXWLLAGGPSSGAPPPSX

SEQ ID NO: 1195 - protein, 40 aa, Artificial Sequence; identical to SEQ ID NO: 1192
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to an acyl or alkyl group
  MISC_FEATURE (40)..(40): C-terminal amidation

SEQ ID NO: 1196 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDKQAAXEFVNWLLAGGPSSGAPPPSX

SEQ ID NO: 1197 - protein, 39 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to acyl or alkyl group
  MISC_FEATURE (39)..(39): C-terminal amidation
YXEGTFTSDYSIYLDKQAAXEFVXWLLAGGPSSGAPPPS

SEQ ID NO: 1198 - protein, 39 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (39)..(39): C-terminal amidation
YXEGTFTSDXSIYLDKQAAXEFVNWLLAGGPSSGAPPPS

SEQ ID NO: 1199 - protein, 40 aa, Artificial Sequence; identical to SEQ ID NO: 1196
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1200 - protein, 29 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (29)..(29): C-terminal amidation
YXQGTFTSDYSIYLDKQAAXEFVXWLLAG

SEQ ID NO: 1201 - protein, 29 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (29)..(29): C-terminal amidation
YXEGTFTSDXSIYLDKQAAXEFVNWLLAG

SEQ ID NO: 1202 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked acyl or alkyl group
  MISC_FEATURE (40)..(40): C-terminal amidation
YXQGTFTSDYSIYLDKQAAXEFVCWLLAGGPSSGAPPPSX

SEQ ID NO: 1203 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVXWLLAGGPSSGAPPPSX

SEQ ID NO: 1204 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation
YXQGTFTSDYSIYLDKQAAXEFVXWLLAGGPSSGAPPPSK

SEQ ID NO: 1205 - protein, 40 aa, Artificial Sequence; identical to SEQ ID NO: 1192
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation

SEQ ID NO: 1206 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1207 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVCWLMNGGPSSGAPPPSX

SEQ ID NO: 1208 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVXWLMNGGPSSGAPPPSX

SEQ ID NO: 1209 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1210 - protein, 40 aa, Artificial Sequence; identical to SEQ ID NO: 1196
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1211 - protein, 40 aa, Artificial Sequence; identical to SEQ ID NO: 1202
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1212 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1213 - protein, 40 aa, Artificial Sequence; identical to SEQ ID NO: 1193
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation

SEQ ID NO: 1214 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1215 - protein, 40 aa, Artificial Sequence; identical to SEQ ID NO: 1194
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation

SEQ ID NO: 1216 - protein, 40 aa, Artificial Sequence; identical to SEQ ID NO: 1194
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation

SEQ ID NO: 1217 - protein, 39 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (40)..(40): C-terminal amidation
YXEGTFTSDXSIYLDKQAAXEFVCWLLAGGPSSGAPPPS

SEQ ID NO: 1218 - protein, 41 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (41)..(41): C-terminal amidation
YXEGTFTSDYSIYLDKQAAXEFVNWLLAGGPSSGAPPPSXC

SEQ ID NO: 1219 - protein, 39 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (24)..(24): Substituted amino acid covalently linked to hydrophilic group
  MISC_FEATURE (39)..(39): C-terminal amidation
YXEGTFTSDXSIYLDKQAAXEFVXWLLAGGPSSGAPPPS

SEQ ID NO: 1220 - protein, 41 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (41)..(41): Substituted amino acid covalently linked to hydrophilic group
  MISC_FEATURE (41)..(41): C-terminal amidation
YXEGTFTSDYSIYLDKQAAXEFVNWLLAGGPSSGAPPPSXX

SEQ ID NO: 1221 - protein, 41 aa, Artificial Sequence
  Synthetic polypeptide
  MOD_RES (2)..(2): Xaa is Aib
  MOD_RES (20)..(20): Xaa is Aib
  MISC_FEATURE (41)..(41): Substituted amino acid covalently linked to hydrophilic group
  MISC_FEATURE (41)..(41): C-terminal amidation
YXEGTFTSDYSIYLDKQAAXEFVNWLLAGGPSSGAPPPSKX

SEQ ID NO: 1222 - protein, 40 aa, Artificial Sequence
  Synthetic polypeptide
  MOD_RES (2)..(2): Xaa is Aib
  MISC_FEATURE (40)..(40): Substituted amino acid covalently linked to acyl or alkyl group
  MISC_FEATURE (40)..(40): C-terminal amidation
HXQGTFTSDYSKYLDEQAAKEFICWLMNGGPSSGAPPPSX

SEQ ID NO: 1223 - protein, 40 aa, Artificial Sequence; identical to SEQ ID NO: 1194
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation

SEQ ID NO: 1224 - protein, 40 aa, Artificial Sequence
  Synethic polypeptide
  MOD_RES (2)..(2): Xaa is Aib
  MOD_RES (16)..(16): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDXQAAKEFVNWLLAGGPSSGAPPPSX

SEQ ID NO: 1225 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDXQAAQEFVNWLLAGGPSSGAPPPSX

SEQ ID NO: 1226 - protein, 30 aa, Artificial Sequene; identical to SEQ ID NO: 1179
  Synthetic polypeptide
  MOD_RES (2)..(2): Xaa is Aib
  MISC_FEATURE (24)..(24): Substituted amino acid covalently linked to hydrophilic group

SEQ ID NO: 1227 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDKQAAXEFVNWLLAG

SEQ ID NO: 1228 - protein, 29 aa, Artificial Sequence
  Synthetic polypeptide
  MOD_RES (2)..(2): Xaa is D-Ser, D-Ala, Val, Gly, N-Methyl Ser, N-Methyl Ala, or Aib
  MOD_RES (16)..(16): Xaa is Lys, Glu, Ser, Orn, Dab, Aib or any alpha, alpha-disubstituted amino acid
  MOD_RES (20)..(20): Xaa is any alpha, alpha-disubstituted amino acid
  MOD_RES (27)..(27): Xaa is Ile, Leu, or Nle
  MOD_RES (28)..(28): Xaa is Ala or Gly
  MOD_RES (29)..(29): Xaa is Thr, Ala, or Gly
  MISC_FEATURE (29)..(29): C-terminal amidation
YXQGTFTSDYSIYLDXQAAXEFVNWLXXX

SEQ ID NO: 1229 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSKYLDKRRAXDFVQWLLAG

SEQ ID NO: 1230 - protein, 29 aa, Artificial Sequence
  Synthetic polypeptide
  MOD_RES (2)..(2): Xaa is D-Ser, DAla, Val, Gly, N-Methyl Ser, N-Methyl Ala, or Aib
  MOD_RES (16)..(16): Xaa is Lys, Glu, Ser, Orn, Dab, Aib or any alpha, alpha-disubstituted amino acid
  MOD_RES (20)..(20): Xaa is any alpha, alpha-disubstituted amino acid
  MOD_RES (27)..(27): Xaa is Ile, Leu, or Nle
  MOD_RES (28)..(28): Xaa is Ala or Gly
  MOD_RES (29)..(29): Xaa is Thr, Ala, or Gly
  MOD_RES (29)..(29): C-terminal amidation
YXQGTFTSDYSKYLDXRRAXDFVQWLXXX

SEQ ID NO: 1231 - protein, 41 aa, Artificial Sequence; identical to SEQ ID NO: 1160
  Synthetic polypeptide
  MISC_FEATURE: Homodimer
  MOD_RES (2)..(2): Xaa is Aib
  MOD_RES (20)..(20): Xaa is Aib
  MISC_FEATURE (40)..(40): 14 Carbon fatty acyl group covalently bound to Lysine
  MOD_RES (40)..(40): C-terminal amidation
  DISULFID (41)..(41): Disulfide bond formed with Cys residue of a second peptide having the same structure.

SEQ ID NO: 1232 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFTSDYSIYLDKQAAXEFVNWLMNGGPSSGAPPPSK

SEQ ID NO: 1233 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFISDYSIYLDKQAAXEFVNWLLAGGPSSGAPPPSK

SEQ ID NO: 1234 - protein, 40 aa, Artificial Sequence; identical to SEQ ID NO: 1233
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently bound to Lysine
  MISC_FEATURE (40)..(40): C-terminal amidation

SEQ ID NO: 1235 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently bound to Lysine via a dipeptide spacer
  MISC_FEATURE (40)..(40): C-terminal amidation

SEQ ID NO: 1236 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently bound to Lysine via a dipeptide spacer
  MISC_FEATURE (40)..(40): C-terminal amidation

SEQ ID NO: 1237 - protein, 40 aa, Artificial Sequence; identical to SEQ ID NO: 765
  Synthetic polypeptide
  MOD_RES (2)..(2): Xaa is Aib
  MISC_FEATURE (10)..(10): 16 Carbon fatty acyl group covalently bound to Lysine via dipeptide spacer
  MOD_RES (20)..(20): Xaa is Aib
  MISC_FEATURE (40)..(40): C-terminal amidation

SEQ ID NO: 1238 - protein, 41 aa, Artificial Sequence; identical to SEQ ID NO: 1160
  Synthetic polypeptide
  MISC_FEATURE: Homodimer
  MOD_RES (2)..(2): Xaa is Aib
  MOD_RES (20)..(20): Xaa is Aib
  MISC_FEATURE (40)..(40): 14 Carbon fatty acyl group covelently bound to Lysine
  MISC_FEATURE (41)..(41): C-terminal amidation
  MISC_FEATURE (41)..(41): Cys residue covalently attached to 20 kDa PEG which is in turn covalently attached to a Cys residue of a second peptide having the same structure

SEQ ID NO: 1239 - protein, 41 aa, Artificial Sequence; identical to SEQ ID NO: 1160
  Synthetic polypeptide
  MISC_FEATURE: homodimer
  MOD_RES (2)..(2): Xaa is Aib
  MOD_RES (20)..(20): Xaa is Aib
  MISC_FEATURE (40)..(40): 14 Carbon fatty acyl group covalently bound to Lysine
  MISC_FEATURE (41)..(41): PEG (5kDa) covalently bound to Cysteine
  MISC_FEATURE (41)..(41): C-terminal amidation
  MISC_FEATURE (41)..(41): Cys residue covalently attached to 5 kDa PEG which is in turn covalently attached to a Cys residue of a second peptide having the same structure

SEQ ID NO: 1240 - protein, 29 aa, Artificial Sequence
  Synthetic polypeptide
  MOD_RES (3)..(3): Xaa is a Glutamine analog
  MOD_RES (27)..(27): Xaa is Nle
HSXGTFTSDYSKYLDTRRAAEFVAWLXDE

SEQ ID NO: 1241 - protein, 29 aa, Artificial Sequence
  Synthetic polypeptide
  MOD_RES (3)..(3): Xaa is a Glutamine analog
  MOD_RES (16)..(16): Xaa is Aib
HSXGTFTSDYSKYLDXRRAADFVAWLMDE

SEQ ID NO: 1242 - protein, 29 aa, Artificial Sequence
  Synthetic polypeptide
  MOD_RES (27)..(27): Xaa is Nle
HSQGTFTSDYSKYLDTRRAAEFVAWLXDE

SEQ ID NO: 1243 - protein, 29 aa, Artificial Sequence
  Synthetic peptide
  MOD_RES (3)..(3): Xaa is Acetamidomethyl-cysteine
  MOD_RES (27)..(27): Xaa is Nle
HSXGTFTSDYSKYLDTRRAAEFVAWLXDE

SEQ ID NO: 1244 - protein, 29 aa, Artificial Sequence
  Synthetic peptide
  MOD_RES (3)..(3): Xaa is Acetyldiaminobutanoic acid
  MOD_RES (27)..(27): Xaa is Nle
HSXGTFTSDYSKYLDTRRAAEFVAWLXDE

SEQ ID NO: 1245 - protein, 29 aa, Artificial Sequence
  Synthetic polypeptide
  MOD_RES (3)..(3): Xaa is carbamoyldiaminopropanoic acid
  MOD_RES (27)..(27): Xaa is Nle
HSXGTFTSDYSKYLDTRRAAEFVAWLXDE

SEQ ID NO: 1246 - protein, 29 aa, Artificial Sequence
  Synthetic polypeptide
  MOD_RES (3)..(3): Xaa is Methylglutamine
  MOD_RES (27)..(27): Xaa is Nle
HSXGTFTSDYSKYLDTRRAAEFVAWLXDE

SEQ ID NO: 1247 - protein, 29 aa, Artificial Sequence
  Synthetic peptide
  MOD_RES (3)..(3): Xaa is Methionine sulfoxide
  MOD_RES (27)..(27): Xaa is Nle
HSXGTFTSDYSKYLDTRRAAEFVAWLXDE

SEQ ID NO: 1248 - protein, 29 aa, Artificial Sequence
  Synthetic peptide
  MOD_RES (3)..(3): Xaa is Acetylornithine
  MOD_RES (27)..(27): Xaa is Nle
HSXGTFTSDYSKYLDTRRAAEFVAWLXDE

SEQ ID NO: 1249 - protein, 29 aa, Artificial Sequence
  Synthetic polypeptide
  MOD_RES (16)..(16): Xaa is Aib
HSQGTFTSDYSKYLDXRRAADFVAWLMDE

SEQ ID NO: 1250 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRAADFVAWLMDE

SEQ ID NO: 1251 - protein, 29 aa, Artificial Sequence
  Synthetic polypeptide
  MOD_RES (3)..(3): Xaa is Methylglutamine
  MOD_RES (16)..(16): Xaa is Aib
HSXGTFTSDYSKYLDXRRAADFVAWLMDE

SEQ ID NO: 1252 - protein, 29 aa, Artificial Sequence
  Synthetic polypeptide
HSQGTFTSDYSKYLDSRRAQDFVQWLMDT

SEQ ID NO: 1253 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRAADFVAWLLDE

SEQ ID NO: 1254 - protein, 39 aa, Artificial Sequence; identical to SEQ ID NO: 604
  Synthetic polypeptide
  MOD_RES (3)..(3): Xaa is Acetyldiaminobutanoic acid
  MOD_RES (16)..(16): Xaa is Aib
  MISC_FEATURE (39)..(39): C-terminal amidation

SEQ ID NO: 1255 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRASDFVSWLLDE

SEQ ID NO: 1256 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRATDFVTWLLDE

SEQ ID NO: 1257-1258 - skipped (2 entries)

SEQ ID NO: 1259 - protein, 40 aa, Artificial Sequence
  Synthetic peptide
  MOD_RES (2)..(2): Xaa is Aib
  MISC_FEATURE (16)..(20): Lactam bridge links Glu16 and Lys20
  MOD_RES (40)..(40): Epsilon amine of Lys is attached to Ala-Ac-Cys(PEG), wherein the Ac-Cys(PEG) is a Cys residue comprising an alpha amino group capped with an acetyl group (CH3CO) and comprising a 40 kDa PEG covalently attached to its side chain
YXQGTFTSDYSIYLDEQAAKEFVNWLLAGGPSSGAPPPSK

SEQ ID NO: 1260 - protein, 40 aa, Artificial Sequence; identical to SEQ ID NO: 1259
  Synthetic peptide
  MOD_RES (2)..(2): Xaa is Aib
  MISC_FEATURE (16)..(20): Lactam bridge links Glu16 and Lys20
  MOD_RES (40)..(40): Epsilon amine of Lys is attached to Arg-Ac-Cys(PEG), wherein the Ac-Cys(PEG) is a Cys residue comprising an alpha amino group capped with an acetyl group (CH3CO) and comprising a 40 kDa PEG covalently attached to its side chain

SEQ ID NO: 1261 - protein, 40 aa, Artificial Sequence; identical to SEQ ID NO: 761
  Synthetic peptide
  MOD_RES (2)..(2): Xaa is Aib
  MISC_FEATURE (16)..(20): Lactam bridge links Glu16 and Lys20
  MOD_RES (40)..(40): Cys-PEG covalently linked via thioether linkage

SEQ ID NO: 1262 - protein, 40 aa, Artificial Sequence
  Synthetic peptide
  MOD_RES (2)..(2): Xaa is Aib
HXQGTFTSDYSKYLDERRAQDFVQWLMNTGPSSGAPPPSK

SEQ ID NO: 1263-1300 - skipped (38 entries)

SEQ ID NO: 1301 - protein, 29 aa, Homo sapiens
HSQGTFTSDYSKYLDSRRAQDFVQWLMNT

SEQ ID NO: 1302 - protein, 28 aa, Artificial Sequence
  Synthetic Polypeptide
  MISC_FEATURE: Glucagon analogue
  MISC_FEATURE (8)..(8): Xaa is aspartic acid, glutamic acid, cysteic acid or homocysteic acid
SQGTFTSXYSKYLDSRRAQDFVQWLMNT

SEQ ID NO: 1303 - protein, 27 aa, Artificial Sequence
  Synthetic Polypeptide
  MISC_FEATURE: Glucagon analogue
  MISC_FEATURE (7)..(7): Xaa is aspartic acid, glutamic acid, cysteic acid or homocysteic acid
QGTFTSXYSKYLDSRRAQDFVQWLMNT

SEQ ID NO: 1304 - protein, 26 aa, Artificial Sequence
  Synthetic Polypeptide
  MISC_FEATURE: Glucagon analogue
  MISC_FEATURE (6)..(6): Xaa is aspartic acid, glutamic acid, cysteic acid or homocysteic acid
GTFTSXYSKYLDSRRAQDFVQWLMNT

SEQ ID NO: 1305 - protein, 25 aa, Artificial Sequence
  Synthetic Polypeptide
  MISC_FEATURE: Glucagon analogue
  MISC_FEATURE (5)..(5): Xaa is aspartic acid, glutamic acid, cysteic acid or homocysteic acid
TFTSXYSKYLDSRRAQDFVQWLMNT

SEQ ID NO: 1306 - protein, 24 aa, Artificial Sequence
  Synthetic Polypeptide
  MISC_FEATURE: Glucagon analogue
  MISC_FEATURE (4)..(4): Xaa is glutamic acid, cysteic acid or homocysteic acid
  MISC_FEATURE (22)..(22): Xaa at position 22 is Met, Leu or Nle
FTSXYSKYLDSRRAQDFVQWLXNT

SEQ ID NO: 1307 - protein, 24 aa, Artificial Sequence
  Synthetic Polypeptide
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNT

SEQ ID NO: 1308 - protein, 24 aa, Artificial Sequence
  Synthetic Polypeptide
  MOD_RES (1)..(1): N-terminal amino group replaced with hydroxy group
  MISC_FEATURE (22)..(22): Xaa is  Met, Leu or Nle
  MOD_RES (24)..(24): C-terminal alpha carboxylate replaced with amide
FTSDYSRYLDSRRAQDFVQWLXNT

SEQ ID NO: 1309 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (11)..(11): Xaa is Lys, Cys, Orn, homocysteine or acetyl phenyalanine
  MISC_FEATURE (22)..(22): Xaa is Met, Leu or Nle
FTSXYSXYLDXRRAQDFVQWLXNT

SEQ ID NO: 1310 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is is Lys or Arg
  MISC_FEATURE (16)..(16): Xaa is Lys, Cys, Orn, homocysteine or acetyl phenylalanine
  MISC_FEATURE (22)..(22): Xaa is Met, Leu or Nle
FTSXYSXYLDSRRAQXFVQWLXNT

SEQ ID NO: 1311 - protein, 24 aa, Artificial Sequence
  Synthetic Polypetide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MISC_FEATURE (22)..(22): Xaa is Met, Leu or Nle
FTSXYSXYLDSRRAQDFVXWLXNT

SEQ ID NO: 1312 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (11)..(11): Xaa is Lys, Cys, Orn, homocysteine or acetyl phenylalanine
  MISC_FEATURE (19)..(19): Xaa is Lys, Cys, Orn, homocysteine or acetyl phenylalanine
  MISC_FEATURE (22)..(22): Xaa is Met, Leu or Nle
FTSXYSXYLDXRRAQDFVXWLXNT

SEQ ID NO: 1313 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (11)..(11): Pegylated
  MISC_FEATURE (22)..(22): Xaa is Met, Leu or Nle
FTSXYSKYLDCRRAQDFVQWLXNT

SEQ ID NO: 1314 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (19)..(19): Pegylated
  MISC_FEATURE (22)..(22): Xaa is Met, Leu or Nle
FTSXYSKYLDSRRAQDFVCWLXNT

SEQ ID NO: 1315 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MOD_RES (24)..(24): Pegylated
FTSXYSKYLDSRRAQDFVQWLXNC

SEQ ID NO: 1316 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (19)..(19): Pegylated
  MISC_FEATURE (22)..(22): Xaa is Met, Leu or Nle
FTSXYSRYLDSRRAQDFVKWLXNT

SEQ ID NO: 1317 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (11)..(11): Pegylated
  MISC_FEATURE (22)..(22): Xaa is Met, Leu or Nle
FTSXYSKYLDCRRAQDFVCWLXNT

SEQ ID NO: 1318 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MOD_RES (24)..(24): C-terminal alpha carboxylate replaced with amide
FTSXYSKYLECRRAQDFVQWLXNT

SEQ ID NO: 1319 - protein, 10 aa, Artificial Sequence
  Synthetic Polypeptide
  MISC_FEATURE: Peptide fragment representing the carboxy terminal 10 amino acids of Exendin-4
GPSSGAPPPS

SEQ ID NO: 1320 - protein, 8 aa, Artificial Sequence
  Synthetic Polypeptide
  MISC_FEATURE: Peptide fragment representing the carboxy terminal 8 amino acids of oxyntomodulin
KRNRNNIA

SEQ ID NO: 1321 - protein, 4 aa, Artificial Sequence
  Synthetic Polypeptide
  MISC_FEATURE: Peptide fragment representing the carboxy 4 amino acids of oxyntomodulin carboxy terminus
KRNR

SEQ ID NO: 1322 - protein, 24 aa, Artificial Sequence
  Synthetic Polypeptide
  MISC_FEATURE: Glucagon analogue
  MISC_FEATURE (7)..(7): Xaa is Lys or Arg
  MISC_FEATURE (11)..(11): Xaa is Lys, Cys, Orn, homocycstein or acetyl phenyalanine
  MISC_FEATURE (19)..(19): Xaa is Lys, Cys, Orn, homocycstein or acetyl phenyalanine
FTSRYSXYLDXRRAQDFVXWLMNT

SEQ ID NO: 1323 - protein, 34 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MISC_FEATURE (22)..(22): Xaa is Met, Leu or Nle
FTSXYSXYLDSRRAQXFVQWLXNTGPSSGAPPPS

SEQ ID NO: 1324 - protein, 32 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTKRNRNNIA

SEQ ID NO: 1325 - protein, 34 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTGPSSGAPPPS

SEQ ID NO: 1326 - protein, 32 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MOD_RES (16)..(16): Pegylation
  MISC_FEATURE (22)..(22): Xaa is Met, Leu or Nle
FTSXYSXYLDSRRAQXFVQWLXNTKRNRNNIA

SEQ ID NO: 1327 - protein, 28 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MOD_RES (16)..(16): Pegylated
  MISC_FEATURE (22)..(22): Xaa is Met, Leu or Nle
FTSXYSXYLDSRRAQXFVQWLXNTKRNR

SEQ ID NO: 1328 - protein, 28 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTKRNR

SEQ ID NO: 1329 - protein, 34 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNTGPSSGAPPPS

SEQ ID NO: 1330 - protein, 32 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNTKRNRNNIA

SEQ ID NO: 1331 - protein, 28 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQCFVQWLXNTKRNR

SEQ ID NO: 1332 - protein, 29 aa, Artificial Sequence
  Synthetic Polypeptide
  MISC_FEATURE: Glucagon analogue
HSQGTFTSDYSKYLDSCRAQDFVQWLMNT

SEQ ID NO: 1333 - protein, 39 aa, Artificial Sequence; identical to SEQ ID NO: 521
  Synthetic Polypeptide
  MISC_FEATURE: Glucagon analogue

SEQ ID NO: 1334 - protein, 29 aa, Artificial Sequence
  Synthetic Polypeptide
  MISC_FEATURE: Glucagon analogue
  MOD_RES (24)..(24): 2-butyrolactone bound through thiol group of Cysteine
HSQGTFTSDYSKYLDSRRAQCFVQWLMNT

SEQ ID NO: 1335 - protein, 29 aa, Artificial Sequence
  Synthetic Polypeptide
  MISC_FEATURE: Glucagon Analogue
  MOD_RES (24)..(24): Carboxymethyl group bound through thiol group of Cysteine
HSQGTFTSDYSKYLDSRRAQCFVQWLMNT

SEQ ID NO: 1336 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLESRRAQDFVQWLXNT

SEQ ID NO: 1337 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (22)..(22): Xaa is Met, Leu or Nle
FTSDYSKYLDSRRAQDFVQWLXNT

SEQ ID NO: 1338 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (22)..(22): Xaa is Met, Leu or Nle
FTSDYSKYLESRRAQDFVQWLXNT

SEQ ID NO: 1339 - protein, 24 aa, Artificial Sequence
  Synthetic Polypeptide
  MISC_FEATURE: Glucagon analogue
  MISC_FEATURE (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MISC_FEATURE (23)..(23): Xaa is Asn, Asp, Glu, cysteic acid or homocysteic acid
  MISC_FEATURE (24)..(24): Xaa id Thr, Asp, Glu, cysteic acid or homocysteic acid
FTSXYSKYLDSRRAQDFVQWLXXX

SEQ ID NO: 1340 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVQWLXXX

SEQ ID NO: 1341 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn, Asp or Glu
  MISC_FEATURE (24)..(24): Xaa is Thr, glu or Asp
FTSXYSKYLXSRRAQDFVQWLXXX

SEQ ID NO: 1342 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVQWLXXX

SEQ ID NO: 1343 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (11)..(11): 20kDa PEG group attached to Xaa at position 11
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXCRRAQDFVQWLXXX

SEQ ID NO: 1344 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (16)..(16): 20kDa PEG group attached to Xaa at position 16
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQCFVQWLXXX

SEQ ID NO: 1345 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (19)..(19): Pegylated
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVCWLXXX

SEQ ID NO: 1346 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
  MISC_FEATURE (25)..(25): Xaa is Lys, Cys, Orn, homocycstein or acetyl phenyalanine
  MOD_RES (25)..(25): Pegylated
FTSXYSKYLXSRRAQDFVQWLXXXXGPSSGAPPPS

SEQ ID NO: 1347 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
  MISC_FEATURE (35)..(35): Xaa is Lys, Cys, Orn, homocysteine or acetyl phenyalanine
  MOD_RES (35)..(35): Pegylated
FTSXYSKYLXSRRAQDFVQWLXXXGPSSGAPPPSX

SEQ ID NO: 1348 - protein, 39 aa, Artificial Sequence
  Synthetic Polypeptide
  MISC_FEATURE: Glucagon analogue
HSQGTFTSDYSRYLDSRRAQDFVQWLMNTGPSSGAPPPS

SEQ ID NO: 1349 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (22)..(22): Xaa is Met , Leu or Nle
  MISC_FEATURE (35)..(35): Xaa is Lys, Cys, Orn, homocysteine or acetyl phenyalanine
  MOD_RES (35)..(35): Pegylated
FTSXYSXYLDSRRAQDFVQWLXNTGPSSGAPPPSX

SEQ ID NO: 1350 - protein, 24 aa, Artificial Sequence
  Synthetic Polypeptide
  MISC_FEATURE: Glucagon analogue
  MOD_RES (1)..(1): N-terminal amino group replaced with hydroxy group
FTSEYSKYLDSRRAQDFVQWLMNT

SEQ ID NO: 1351 - protein, 20 aa, Artificial Sequence
  Synthetic Polypeptide
  MISC_FEATURE: Glucagon analogue
YSKYLDSRRAQDFVQWLMNT

SEQ ID NO: 1352 - protein, 24 aa, Artificial Sequence
  Synthetic Polypeptide
  MISC_FEATURE: Glucagon analogue
  MISC_FEATURE (4)..(4): Xaa is Homocysteic acid
FTSXYSKYLDSRRAQDFVQWLMNT

SEQ ID NO: 1353 - protein, 11 aa, Artificial Sequence
  Synthetic Polypeptide
  MISC_FEATURE: Peptide fragment representing the carboxy terminal 10 amino acids of Exendin-4
  MISC_FEATURE (11)..(11): Xaa is Lys, Cys, Orn, homocysteine or acetyl phenyalanine
GPSSGAPPPSX

SEQ ID NO: 1354 - protein, 6 aa, Artificial Sequence
  Synthetic Polypeptide
  MISC_FEATURE (6)..(6): Xaa is phenyl lactic acid
HSQGTX

SEQ ID NO: 1355 - protein, 5 aa, Artificial Sequence
  Synthetic Polypeptide
  MISC_FEATURE (5)..(5): Xaa is phenyl lactic acid
SQGTX

SEQ ID NO: 1356 - protein, 4 aa, Artificial Sequence
  Synthetic Polypeptide
  MISC_FEATURE (4)..(4): Xaa is phenyl lactic acid
QGTX

SEQ ID NO: 1357 - protein, 3 aa, Artificial Sequence
  Synthetic Polypeptide
  MISC_FEATURE (3)..(3): Xaa is phenyl lactic acid
GTX

SEQ ID NO: 1358 - protein, 2 aa, Artificial Sequence
  Synthetic Polypeptide
  MISC_FEATURE (2)..(2): Xaa is phenyl lactic acid
TX

SEQ ID NO: 1359 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
  MISC_FEATURE (6)..(6): Xaa is phenyl lactic acid
XXXGTX

SEQ ID NO: 1360 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
  MISC_FEATURE (5)..(5): Xaa is phenyl lactic acid
XXGTX

SEQ ID NO: 1361 - protein, 4 aa, Artificial Sequence
  Synthetic Polypeptide
  MISC_FEATURE (1)..(1): Xaa is selected from a group consisting of Glu and Gln
  MISC_FEATURE (4)..(4): Xaa is phenyl lactic acid
XGTX

SEQ ID NO: 1362 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate optionally replaced with amide
FTSDYSKYLDSRRAQDFVQWLMDT

SEQ ID NO: 1363 - protein, 28 aa, Artificial Sequence
  Synthetic Polypeptide
  MOD_RES (28)..(28): C-terminal alpha carboxylate optionally replaced with amide
SQGTFTSEYSKYLDSRRAQDFVQWLMNT

SEQ ID NO: 1364 - protein, 28 aa, Artificial Sequence
  Synthetic Polypeptide
  MISC_FEATURE (4)..(5): Threonine in position 4 and phenyl lactic acid in position 5 linked via ester bond
  MISC_FEATURE (5)..(5): Xaa is phenyl lactic acid
  MOD_RES (28)..(28): Optional C-terminal alpha carboxylate replaced with amide
  MOD_RES (28)..(28): C-terminal alpha carboxylate optionally replaced with amide
SQGTXTSEYSKYLDSRRAQDFVQWLMNT

SEQ ID NO: 1365 - protein, 29 aa, Artificial Sequence
  Synthetic Polypeptide
  MISC_FEATURE (5)..(6): Threonine in position 5 and phenyl lactic acid in position 6 linked via ester bond
  MISC_FEATURE (6)..(6): Xaa is phenyl lactic acid
  MOD_RES (29)..(29): C-terminal alpha carboxylate optionally replaced with amide
HSQGTXTSEYSKYLDSRRAQDFVQWLMNT

SEQ ID NO: 1366 - protein, 24 aa, Artificial Sequence
  Synthetic Polypeptide
  MOD_RES (1)..(1): N-terminal amino group replaced with hydroxy group
  MISC_FEATURE (11)..(11): Xaa is amino isobutyric acid
FTSDYSKYLDXRRAQDFVQWLMNT

SEQ ID NO: 1367 - protein, 24 aa, Artificial Sequence
  Synthetic Polypeptide
  MOD_RES (1)..(1): N-terminal amino group replaced with hydroxy group
FTSDYSKYLDERRAQDFVQWLMNT

SEQ ID NO: 1368 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
XXXTGF

SEQ ID NO: 1369 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
XXTGF

SEQ ID NO: 1370 - protein, 4 aa, Artificial Sequence
  Synthetic Polypeptide
  MISC_FEATURE (1)..(1): Xaa is selected from a group consisting of Glu or Gln
XTGF

SEQ ID NO: 1371 - protein, 24 aa, Artificial Sequence
  Synthetic Polypeptide
  MOD_RES (1)..(1): N-terminal amino group replaced with hydroxy group
  MISC_FEATURE (24)..(24): C-terminal alpha carboxylate optionally replaced with an amide
FTSEYSKYLDSRRAQDFVQWLMNT

SEQ ID NO: 1372-1400 - skipped (29 entries)

SEQ ID NO: 1401 - protein, 29 aa, Homo sapiens
HSQGTFTSDYSKYLDSRRAQDFVQWLMNT

SEQ ID NO: 1402 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDSRRAQDFVQWLMNT

SEQ ID NO: 1403 - protein, 31 aa, Homo sapiens; identical to SEQ ID NO: 703

SEQ ID NO: 1404 - protein, 30 aa, Homo sapiens; identical to SEQ ID NO: 704

SEQ ID NO: 1405 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDERRAQDFVQWLMNT

SEQ ID NO: 1406 - protein, 24 aa, Artificial Sequence
  Synthetic Polypeptide
  MOD_RES (1)..(1): N-terminal amino group replaced with hydroxy group
FTSDYSKYLDERRAKDFVQWLMNT

SEQ ID NO: 1407 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ser or Glu
FTSDYSKYLDXRRAKDFVEWLMNT

SEQ ID NO: 1408 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ser or Glu
FTSDYSKYLDXRRAQDFVEWLMKT

SEQ ID NO: 1409 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(7): Xaa at position 7 is Lys or Glu
  MISC_FEATURE (10)..(10): Xaa is Asp, Glu, homoglutamic acid, cysteic acid or homocysteic acid
  MISC_FEATURE (11)..(11): Xaa is Ala, Ser, Glu, Lys, homoglutamic acid or homocysteic acid
  MISC_FEATURE (15)..(15): Xaa is Gln, Glu or Lys
  MISC_FEATURE (19)..(19): Xaa is Ala, Gln, Lys or Glu
  MISC_FEATURE (23)..(23): Xaa is Asn, Lys or an acidic amino acid
  MISC_FEATURE (24)..(24): Xaa is Thr or an acidic amino acid
FTSDYSXYLXXRRAXDFVXWLMXX

SEQ ID NO: 1410 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ala, Ser, Glu, Gln, homoglutamic acid or homocysteic acid
  MISC_FEATURE (15)..(15): Xaa is Gln or Lys
  MISC_FEATURE (19)..(19): Xaa is Ala, Gln or Glu
  MISC_FEATURE (23)..(23): Xaa is Asn, Lys or an acidic amino acid
FTSDYSKYLDXRRAXDFVXWLMXT

SEQ ID NO: 1411 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ala, Ser, Glu, Gln, homoglutamic acid or homocysteic acid
  MISC_FEATURE (15)..(15): Xaa is Gln or Lys
FTSDYSKYLDXRRAXDFVQWLMNT

SEQ ID NO: 1412 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (15)..(15): Xaa is Lys or Gln
  MISC_FEATURE (16)..(16): Xaa is Lys, Cys, Orn, homocysteine or acetyl phenyalanine
  MOD_RES (16)..(16): Pegylated
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDERRAXXFVXWLXNT

SEQ ID NO: 1413 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (15)..(15): Xaa is Lys or Gln
  MISC_FEATURE (16)..(16): Xaa is Cys, Orn, homocysteine or acetyl phenyalanine
  MOD_RES (16)..(16): Pegylated
  MISC_FEATURE (22)..(22): Xaa is Met, Leu or Nle
FTSXYSKYLDERRAXXFVQWLXNT

SEQ ID NO: 1414 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (15)..(15): Xaa is Lys or Gln
  MISC_FEATURE (19)..(19): Xaa is Cys, Orn, homocysteine or acetyl phenylalanine
  MOD_RES (19)..(19): Pegylated
  MISC_FEATURE (22)..(22): Xaa is Met, Leu or Nle
FTSXYSKYLDERRAXDFVXWLXNT

SEQ ID NO: 1415 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid, homoglutamic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteic acid
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys or an acidic amino acid
  MISC_FEATURE (24)..(24): Xaa is Thr or an acidic amino acid
FTSXYSXYLXXRRAXDFVXWLXXX

SEQ ID NO: 1416 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11
  MISC_FEATURE (10)..(10): Xaa is Glu or Asp
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXERRAQDFVQWLXXT

SEQ ID NO: 1417 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXERRAKDFVQWLXXT

SEQ ID NO: 1418 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(11): Xaa is Ser or Glu
  MISC_FEATURE (15)..(19): Lactam bridge connecting residues 15 and 19
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXXRRAKDFVEWLXXT

SEQ ID NO: 1419 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(11): Xaa is Ser or Glu
  MISC_FEATURE (19)..(23): Lactam bridge connecting residues 19 and 23
  MISC_FEATURE (22)..(22): Xaa is Met, Leu or Nle
  MISC_FEATURE (24)..(24): Xaa is Thr or Glu
  MOD_RES (24)..(24): C-terminal alpha carboxylate replaced with amide
FTSDYSKYLXXRRAQDFVEWLXKX

SEQ ID NO: 1420 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteine
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys, Asp, Glu, cysteic acid or homocysteic acid
  MISC_FEATURE (24)..(24): Xaa is Thr, Asp, Glu, cysteic acid and homocysteic acid
FTSXYSXYLXXRRAXDFVXWLXXX

SEQ ID NO: 1421 - protein, 10 aa, Artificial Sequence
  Synthetic Polypeptide
  MISC_FEATURE: Peptide fragment representing the carboxy terminal 10 amino acids of Exendin-4
GPSSGAPPPS

SEQ ID NO: 1422 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(11): Lactam bridge connecting residues 7 and 11
  MISC_FEATURE (10)..(10): Xaa is Asp, Glu, cysteic acid, homoglutamic acid and homocysteic acid
  MISC_FEATURE (22)..(22): Xaa is Met, Leu or Nle
FTSXYSKYLXERRAQDFVQWLXNT

SEQ ID NO: 1423 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (11)..(15): Lactam bridge connecting residues 11 and 15
  MISC_FEATURE (22)..(22): Xaa is Met, Leu or Nle
FTSXYSKYLXERRAKDFVQWLXNT

SEQ ID NO: 1424 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (15)..(19): Lactam bridge connecting residues 15 and 19
  MISC_FEATURE (22)..(22): Xaa is Met, Leu or Nle
FTSXYSKYLXERRAKDFVEWLXNT

SEQ ID NO: 1425 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (19)..(24): Lactam bridge connecting residues 19 and 24
  MISC_FEATURE (22)..(22): Xaa is Met, Leu or Nle
FTSXYSKYLXERRAQDFVEWLXKT

SEQ ID NO: 1426 - protein, 8 aa, Artificial Sequence
  Synthetic Polypeptide
  MISC_FEATURE: Peptide fragment representing the carboxy terminal 8 amino acids of oxyntomodulin
KRNRNNIA

SEQ ID NO: 1427 - protein, 4 aa, Artificial Sequence
  Synthetic Polypeptide
  MISC_FEATURE: Peptide fragment representing the carboxy 4 amino acids of oxyntomodulin carboxy terminus
KRNR

SEQ ID NO: 1428 - protein, 34 aa, Artificial Sequence
  Synthetic Polypeptide
  MISC_FEATURE: Glucagon analogue
FTSEYSKYLDERRAQDFVQWLMNTGPSSGAPPPS

SEQ ID NO: 1429 - protein, 34 aa, Artificial Sequence; identical to SEQ ID NO: 1428
  Synthetic Polypeptide
  MISC_FEATURE (7)..(11): Lactam bridge connecting residues 7 and 11

SEQ ID NO: 1430 - protein, 34 aa, Artificial Sequence
  Synthetic Polypeptide
  MISC_FEATURE: Glucagon analogue
  MISC_FEATURE (11)..(15): Lactam bridge connecting residues 11 and 15
FTSEYSKYLDERRAKDFVQWLMNTGPSSGAPPPS

SEQ ID NO: 1431 - protein, 34 aa, Artificial Sequence
  Synthetic Polypeptide
  MISC_FEATURE: Glucagon analogue
  MISC_FEATURE (7)..(11): Lactam bridge connecting residues 7 and 11
FTSDYSKYLDERRAQDFVQWLMNTGPSSGAPPPS

SEQ ID NO: 1432 - protein, 34 aa, Artificial Sequence; identical to SEQ ID NO: 1428
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11

SEQ ID NO: 1433 - protein, 34 aa, Artificial Sequence; identical to SEQ ID NO: 1430
  Synthetic Polypeptide
  MISC_FEATURE: Glucagon analogue
  MOD_RES (1)..(1): N-terminal amino group replaced with hydroxy group
  MISC_FEATURE (11)..(15): Lactam bridge connecting residues 11 and 15

SEQ ID NO: 1434 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDSRRAQDFVQWLMDT

SEQ ID NO: 1435 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11
FTSEYSKYLDERRAQDFVQWLMNT

SEQ ID NO: 1436 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(15): Lactam bridge connecting residues 11 and 15
FTSEYSKYLDERRAKDFVQWLMNT

SEQ ID NO: 1437 - protein, 31 aa, Artificial Sequence
  Synthetic Polypeptide
  MISC_FEATURE: Glucagon analogue
HSQGTFTSDYARYLDARRAREFIKWLVRGRG

SEQ ID NO: 1438 - protein, 24 aa, Artificial Sequence
  Synthetic Polypeptide
  MISC_FEATURE: Glucagon analogue
  MOD_RES (1)..(1): N-terminal amino group replaced with hydroxy group
  MOD_RES (24)..(24): C-terminal alpha carboxylate replaced with amide
FTSDYSKYLDERRAQDFVQWLMNT

SEQ ID NO: 1439 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MOD_RES (24)..(24): C-terminal alpha carboxylate replaced with amide
FTSXYSKYLXERRAKDFVQWLXNT

SEQ ID NO: 1440 - protein, 29 aa, Artificial Sequence
  Synthetic Polypeptide
  MISC_FEATURE: Glucagon analogue
HSQGTFTSDYSKYLDSCRAQDFVQWLMNT

SEQ ID NO: 1441 - protein, 39 aa, Artificial Sequence; identical to SEQ ID NO: 521
  Synthetic Polypeptide
  MISC_FEATURE: Glucagon Analogue

SEQ ID NO: 1442 - protein, 29 aa, Artificial Sequence
  Synthetic Polypeptide
  MISC_FEATURE: Glucagon analogue
  MOD_RES (24)..(24): 2-butyrolactone bound through thiol group of Cysteine
HSQGTFTSDYSKYLDSRRAQCFVQWLMNT

SEQ ID NO: 1443 - protein, 29 aa, Artificial Sequence
  Synthetic Polypeptide
  MISC_FEATURE: Glucagon Analogue
  MOD_RES (21)..(21): Carboxymethyl group bound through thiol group of Cysteine
HSQGTFTSDYSKYLDSRRAQCFVQWLMNT

SEQ ID NO: 1444 - protein, 39 aa, Homo sapiens
HSQGTFTSDYSRYLDSRRAQDFVQWLRNTGPSSGAPPPS

SEQ ID NO: 1445 - protein, 35 aa, Artificial Sequence; identical to SEQ ID NO: 1346
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(11): Lactam bridge connecting residues 7 and 11
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn, Lys, Asp, Glu, cysteic acid and homocysteic acid
  MISC_FEATURE (24)..(24): Xaa is Thr, Asp, Glu, cysteic acid and homocysteic acid
  MISC_FEATURE (25)..(25): Xaa is Cys, Orn, homocysteine or acetyl phenyalanine
  MOD_RES (25)..(25): Pegylated

SEQ ID NO: 1446 - protein, 35 aa, Artificial Sequence; identical to SEQ ID NO: 1347
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Lys, Asp, Glu, cysteic acid and homocysteic acid
  MISC_FEATURE (24)..(24): Xaa is Thr, Asp, Glu, cysteic acid and homocysteic acid
  MISC_FEATURE (35)..(35): Xaa is Cys, Orn, homocysteine or acetyl phenyalanine
  MOD_RES (35)..(35): Pegylated

SEQ ID NO: 1447 - protein, 24 aa, Artificial Sequence
  Synthetic Polypeptide
  MISC_FEATURE: Glucagon analogue
  MISC_FEATURE (4)..(4): Xaa is glutamic acid, homoglutamic acid, cysteic acid or homocysteic acid
  MISC_FEATURE (7)..(11): Lactam bridge connecting residues 7 and 11
  MISC_FEATURE (10)..(10): Xaa is Glu or Asp
  MISC_FEATURE (22)..(22): Xaa is Met, Leu or Nle
  MISC_FEATURE (23)..(23): Xaa is Asn, Asp or Glu
FTSXYSKYLXERRAQDFVQWLXXT

SEQ ID NO: 1448 - protein, 24 aa, Artificial Sequence
  Synthetic Polypeptide
  MISC_FEATURE: Glucagon analogue
  MISC_FEATURE (4)..(4): Xaa is glutamic acid, homoglutamic acid,  cysteic acid or homocysteic acid
  MISC_FEATURE (10)..(10): Xaa is Asp or Glu
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Asp or Glu
FTSXYSKYLXERRAKDFVQWLXXT

SEQ ID NO: 1449 - protein, 23 aa, Artificial Sequence
  Synthetic Polypeptide
  MISC_FEATURE: Glucagon analogue
TSDYSKYLDERRAKDFVQWLMDT

SEQ ID NO: 1450 - protein, 11 aa, Artificial Sequence
  Synthetic Polypeptide
  MISC_FEATURE: Peptide fragment representing the carboxy terminal 10 amino acids of Exendin-4 plus one additional amino acid
  MISC_FEATURE (11)..(11): Xaa is selected form the group consisting of Cys, Orn, Lys, homocysteine and acetyl phenyalanine
GPSSGAPPPSX

SEQ ID NO: 1451 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid, homoglutamic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteic acid
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys or an acidic amino acid
  MISC_FEATURE (24)..(24): Xaa is Thr, Gly or an acidic amino acid
FTSXYSXYLXXRRAXDFVXWLXXX

SEQ ID NO: 1452 - protein, 6 aa, Artificial Sequence
  Synthetic Polypeptide
  MISC_FEATURE (6)..(6): Xaa is phenyl lactic acid
HSQGTX

SEQ ID NO: 1453 - protein, 5 aa, Artificial Sequence
  Synthetic Polypeptide
  MISC_FEATURE (5)..(5): Xaa is phenyl lactic acid
SQGTX

SEQ ID NO: 1454 - protein, 4 aa, Artificial Sequence
  Synthetic Polypeptide
  MISC_FEATURE (4)..(4): Xaa is phenyl lactic acid
QGTX

SEQ ID NO: 1455 - protein, 3 aa, Artificial Sequence
  Synthetic Polypeptide
  MISC_FEATURE (3)..(3): Xaa is phenyl lactic acid
GTX

SEQ ID NO: 1456 - protein, 2 aa, Artificial Sequence
  Synthetic Polypeptide
  MISC_FEATURE (2)..(2): Xaa is phenyl lactic acid
TX

SEQ ID NO: 1457 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
  MISC_FEATURE (6)..(6): Xaa is phenyl lactic acid
XXXGTX

SEQ ID NO: 1458 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
  MISC_FEATURE (5)..(5): Xaa is phenyl lactic acid
XXGTX

SEQ ID NO: 1459 - protein, 4 aa, Artificial Sequence
  Synthetic Polypeptide
  MISC_FEATURE (1)..(1): Xaa is selected from a group consisting of Glu or Gln
  MISC_FEATURE (4)..(4): Xaa is phenyl lactic acid
XGTX

SEQ ID NO: 1460 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKDFVQWLMDT

SEQ ID NO: 1461 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSEYSKYLDSRRAQDFVQWLMNT

SEQ ID NO: 1462 - protein, 24 aa, Artificial Sequence
  Synthetic Polypeptide
  MOD_RES (1)..(1): N-terminal amino group replaced with hydroxy group
  MISC_FEATURE (4)..(7): Lactam bridge connecting residues 4 and 7
  MOD_RES (24)..(24): C-terminal alpha carboxylate replaced with amide
FTSEYSKYLDSRRAQDFVQWLMNT

SEQ ID NO: 1463 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
AEGTFTSEYSKYLDERRAKDFVQWLMDT

SEQ ID NO: 1464 - protein, 28 aa, Artificial Sequence
  Synthetic Polypeptide
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connecting residues 15 and 19
  MOD_RES (28)..(28): C-terminal alpha carboxylate replaced with amide
AEGTXTSDYSKYLDERRAKDFVQWLMDT

SEQ ID NO: 1465 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
SQGTFTSEYSKYLDERRAKDFVQWLMDT

SEQ ID NO: 1466 - protein, 28 aa, Artificial Sequence
  Synthetic Polypeptide
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connecting residues 15 and 19
  MOD_RES (28)..(28): C-terminal alpha carboxylate replaced with amide
SQGTXTSDYSKYLDERRAKDFVQWLMDT

SEQ ID NO: 1467 - protein, 24 aa, Artificial Sequence
  Synthetic Polypeptide
  MOD_RES (1)..(1): N-terminal amino group replaced with hydroxy group
  MISC_FEATURE (5)..(5): Covalently linked to a cholesterol acid moiety
  MISC_FEATURE (11)..(15): Lactam bridge connecting residues 11 to 15
  MOD_RES (24)..(24): C-terminal alpha carboxylate replaced with amide
FTSDKSKYLDERRAKDFVQWLMDT

SEQ ID NO: 1468 - protein, 25 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (25)..(25): Covalently linked to a cholesterol acid moiety
  MOD_RES (25)..(25): C-terminal alpha carboxylate replaced with amide
FTSDYSKYLDERRAKDFVQWLMDTK

SEQ ID NO: 1469 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connectiong residues 11 and 15
  MISC_FEATURE (35)..(35): Covalently linked to a cholesterol acid moiety
  MOD_RES (35)..(35): C-terminal alpha carboxylate replaced with amide
FTSDYSKYLDERRAKDFVQWLMDTGPSSGAPPPSK

SEQ ID NO: 1470 - protein, 28 aa, Artificial Sequence
  Synthetic Polypeptide
  MISC_FEATURE (1)..(1): Xaa is amino isobutyric acid
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connectiong residues 15 and 19
  MOD_RES (28)..(28): C-terminal alpha carboxylate replaced with amide
XEGTXTSDYSKYLDERRAKDFVQWLMDT

SEQ ID NO: 1471 - protein, 34 aa, Artificial Sequence; identical to SEQ ID NO: 1428
  Synthetic Polypeptide
  MOD_RES (34)..(34): C-terminal alpha carboxylate replaced with amide

SEQ ID NO: 1472 - protein, 34 aa, Artificial Sequence; identical to SEQ ID NO: 1428
  Synthetic Polypeptide
  MOD_RES (1)..(1): N-terminal amino group replaced with hydroxy group
  MOD_RES (34)..(34): C-terminal alpha carboxylate replaced with amide

SEQ ID NO: 1473 - protein, 34 aa, Artificial Sequence; identical to SEQ ID NO: 1430
  Synthetic Polypeptide
  MISC_FEATURE (11)..(15): Lactam bridge connecting residues 11 and 15
  MOD_RES (34)..(34): C-terminal alpha carboxylate replaced with amide

SEQ ID NO: 1474 - protein, 34 aa, Artificial Sequence; identical to SEQ ID NO: 1430
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (34)..(34): C-termincal alpha carboxylate replaced with amide

SEQ ID NO: 1475 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYLDERRAQDFVQWLMDT

SEQ ID NO: 1476 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKDFVQWLMDT

SEQ ID NO: 1477 - protein, 24 aa, Artificial Sequence
  Synthetic Polypeptide
  MOD_RES (1)..(1): N-terminal amino group replaced with hydroxy group
  MISC_FEATURE (15)..(19): Lactam bridge connecting residues 15 and 19
  MOD_RES (24)..(24): C-terminal alpha carboxylate replaced with amide
FTSDYSKYLDERRAKDFVEWLMDT

SEQ ID NO: 1478 - protein, 24 aa, Artificial Sequence
  Synthetic Polypeptide
  MOD_RES (1)..(1): N-terminal amino group replaced with hydroxy group
  MISC_FEATURE (19)..(23): Lactam bridge connecting residues 19 and 23
  MOD_RES (24)..(24): C-terminal alpha carboxylate replaced with amide
FTSDYSKYLDERRAQDFVEWLMKT

SEQ ID NO: 1479 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYLDEQAAKDFIAWLMDT

SEQ ID NO: 1480 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDEQAAKEFIAWLMDT

SEQ ID NO: 1481 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
AEGTFTSEYSKYLDERRAKDFVQWLMDT

SEQ ID NO: 1482 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
AEGTFTSEYSKYLDEQAAKEFIAWLMDT

SEQ ID NO: 1483 - protein, 29 aa, Artificial Sequence
  Synthetic Polypeptide
  MISC_FEATURE (16)..(20): Lactam bridge connection residues 16 and 20
  MOD_RES (29)..(29): C-terminal alpha carboxylate replaced with amide
HAEGTFTSEYSKYLDERRAKDFVQWLMDT

SEQ ID NO: 1484 - protein, 29 aa, Artificial Sequence
  Synthetic Polypeptide
  MISC_FEATURE (16)..(20): Lactam bridge connecting bridges 16 and 20
  MOD_RES (29)..(29): C-terminal alpha carboxylate replaced with amide
HAEGTFTSEYSKYLDEQAAKEFIAWLMDT

SEQ ID NO: 1485 - protein, 26 aa, Artificial Sequence
  Synthetic Polypeptide
  MISC_FEATURE (13)..(17): Lactam bridge connecting residues 13 and 17
  MOD_RES (26)..(26): C-terminal alpha carboxylate replaced with amide
GTFTSEYSKYLDERRAKDFVQWLMDT

SEQ ID NO: 1486 - protein, 28 aa, Artificial Sequence
  Synthetic Polypeptide
  MISC_FEATURE (5)..(6): Threonine in position 5 and phenyl lactic acid in position 6 linked via ester bond
  MISC_FEATURE (15)..(19): Lactam bridge connecting residues 15 and 19
  MOD_RES (28)..(28): C-terminal alpha carboxylate replaced with amide
SQGTFTSEYSKYLDERRAKDFVQWLMDT

SEQ ID NO: 1487 - protein, 29 aa, Artificial Sequence
  Synthetic Polypeptide
  MISC_FEATURE (5)..(6): Threonine at position 5 and phenyl lactic acid at position 6 linked via ester bond
  MISC_FEATURE (6)..(6): Xaa is phenyl lactic acid
  MISC_FEATURE (16)..(20): Lactam bridge connecting residues 16 and 20
  MOD_RES (29)..(29): C-terminal alpha carboxylate replaced with amide
HAEGTXTSDYSKYLDERRAKDFVQWLMDT

SEQ ID NO: 1488 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (19)..(19): Pegylated
  MOD_RES (24)..(24): C-terminal alpha carboxylate replaced with amide
FTSDYSKYLDERRAQDFVCWLMDT

SEQ ID NO: 1489 - protein, 35 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (35)..(35): Pegylated
  MOD_RES (35)..(35): C-terminal alpha carboxylate replaced with amide
FTSDYSKYLDERRAQDFVQWLMDTGPSSGAPPPSC

SEQ ID NO: 1490 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated
  MOD_RES (24)..(24): C-terminal alpha carboxylate replaced with amide
FTSDYSKYLDERRAKDFVCWLMDT

SEQ ID NO: 1491 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDTGPSSGAPPPSC

SEQ ID NO: 1492 - protein, 24 aa, Artificial Sequence
  Synthetic Polypeptide
  MOD_RES (1)..(1): N-terminal amino group replaced with hydroxy group
  MOD_RES (1)..(1): Covalently attached to a C16 fatty acid
  MISC_FEATURE (11)..(15): Lactam bridge connection residues 11 and 15
  MOD_RES (24)..(24): C-terminal alpha carboxylate replaced with amide
FTSDYSKYLDERRAKDFVQWLMDT

SEQ ID NO: 1493 - protein, 24 aa, Artificial Sequence
  Synthetic Polypeptide
  MOD_RES (1)..(1): N-terminal amino group replaced with hydroxy group
  MOD_RES (5)..(5): Linked to a C16 fatty acid via Glu residue
  MISC_FEATURE (11)..(15): Lactam bridge connecting residues 11 and 15
  MISC_FEATURE (15)..(15): Linked to a C16 fatty acid via Glu residue
  MOD_RES (24)..(24): C-terminal alpha carboxylate replaced with amide
FTSDKSKYLDERRAKDFVQWLMDT

SEQ ID NO: 1494 - protein, 24 aa, Artificial Sequence
  Synthetic Polypeptide
  MOD_RES (1)..(1): N-terminal amino group replaced with hydroxy group
  MISC_FEATURE (15)..(15): Linked to C16 fatty acid via Glu residue
  MOD_RES (24)..(24): C-terminal alpha carboxylate replaced with amide
FTSDYSKYLDERRAKDFVQWLMDT

SEQ ID NO: 1495 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (19)..(19): Linked to a C16 fatty acid via Glu residue
  MOD_RES (24)..(24): C-terminal alpha carboxylate replaced with amide
FTSDYSKYLDERRAKDFVKWLMDT

SEQ ID NO: 1496 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (24)..(24): Linked to a C16 fatty acid via Glu residue
  MOD_RES (24)..(24): C-terminal alpha carboxylate replaced with amide
FTSDYSKYLDERRAKDFVQWLMDK

SEQ ID NO: 1497 - protein, 24 aa, Artificial Sequence
  Synthetic Polypeptide
  MOD_RES (1)..(1): N-terminal amino group replaced with hydroxy group
  MISC_FEATURE (11)..(11): Xaa is amino isobutyric acid
  MOD_RES (24)..(24): C-terminal alpha carboxylate replaced with amide
FTSDYSKYLDXRRAQDFVQWLMNT

SEQ ID NO: 1498 - protein, 24 aa, Artificial Sequence
  Synthetic Polypeptide
  MOD_RES (1)..(1): N-terminal amino group replaced with hydroxy group
  MISC_FEATURE (11)..(11)
  MISC_FEATURE (15)..(15): Xaa is alpha isobutyric acid
  MOD_RES (24)..(24): C-terminal alpha carboxylate replaced with amide
FTSDKSKYLDXRRAXDFVCWLMNT

SEQ ID NO: 1499 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDERRAQDFVQWLMNT

SEQ ID NO: 1500 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDKSKYLDERRAQDFVCWLMNT

SEQ ID NO: 1501 - protein, 24 aa, Artificial Sequence
  Synthetic Polypeptide
  MISC_FEATURE (4)..(7): Lactam bridge connecting residues 4 and 7
  MOD_RES (11)..(11): Xaa is alpha isobutyric acid
  MOD_RES (24)..(24): C-terminal carboxylate replaced with amide
FTSEYSKYLDXRRAQDFVQWLMNT

SEQ ID NO: 1502 - protein, 24 aa, Artificial Sequence
  Synthetic Polypeptide
  MISC_FEATURE (4)..(7): Lactam bridge connecting residues 4 and 7
  MOD_RES (11)..(11): Xaa is alpha isobutyric acid
  MOD_RES (24)..(24): C-terminal carboxylate replaced with amide
FTSEYSKYLDXRRAQDFVQWLMNT

SEQ ID NO: 1503 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKEFVQWLMDT

SEQ ID NO: 1504 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDEQAAKEFIAWLMNT

SEQ ID NO: 1505 - protein, 34 aa, Artificial Sequence; identical to SEQ ID NO: 1430
  Synthetic Polypeptide
  MOD_RES (34)..(34): C-terminal alpha carboxylate replaced with amide

SEQ ID NO: 1506 - protein, 24 aa, Artificial Sequence
  Synthetic Polypeptide
  MOD_RES (1)..(1): N-terminal amino group replaced with hydroxy group
  MISC_FEATURE (5)..(5): Linked to a C16 fatty acid via Glu residue
  MISC_FEATURE (7)..(7): Linked to a C16 fatty acid via Glu residue
  MOD_RES (24)..(24): C-terminal carboxylate replaced with amide
FTSDKSKYLDERRAKDFVQWLMDT

SEQ ID NO: 1507 - protein, 6 aa, Artificial Sequence
  Synthetic Polypeptide
  MISC_FEATURE (1)..(1): Xaa1 is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, valine, glycine, N-methyl serine, and aminoisobutyric acid (AIB)
  MISC_FEATURE (3)..(3): Xaa is selected from a group consisting of Glu or Gln
XXXTGF

SEQ ID NO: 1508 - protein, 5 aa, Artificial Sequence
  Synthetic Polypeptide
  MISC_FEATURE (1)..(1): Xaa is selected from a group consisting of Ser, D-serine, D-alanine, valine, glycine, N-methyl serine, and aminoisobutyric acid (AIB)
  MISC_FEATURE (2)..(2): Xaa is selected from a group consisting of Glu or Gln
XXTGF

SEQ ID NO: 1509 - protein, 4 aa, Artificial Sequence
  Synthetic Polypeptide
  MISC_FEATURE (1)..(1): Xaa is selected from a group consisting of Glu or Gln
XTGF

SEQ ID NO: 1510 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDSRRAQDFVQWLMDT

SEQ ID NO: 1511 - protein, 28 aa, Artificial Sequence
  Synthetic Polypeptide
  MOD_RES (28)..(28): C-terminal alpha carboxylate replaced with amide
SQGTFTSEYSKYLDSRRAQDFVQWLMNT

SEQ ID NO: 1512 - protein, 28 aa, Artificial Sequence
  Synthetic Polypeptide
  MISC_FEATURE (4)..(5): Threonine at position 4 and phenyl lactic acid at position 5 linked via ester bond
  MISC_FEATURE (5)..(5): Xaa is phenyl lactic acid
  MOD_RES (28)..(28): C-terminal alpha carboxylate replaced with amide
SQGTXTSEYSKYLDSRRAQDFVQWLMNT

SEQ ID NO: 1513 - protein, 29 aa, Artificial Sequence
  Synthetic Polypeptide
  MISC_FEATURE (5)..(6): Threorine at position 5 and phenyl lactic acid at position 6 linked via ester bond
  MISC_FEATURE (6)..(6): Xaa is phenyl lactic acid
  MOD_RES (29)..(29): C-terminal alpha carboxylate replaced with amide
HSQGTXTSEYSKYLDSRRAQDFVQWLMNT

SEQ ID NO: 1514 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated
  MOD_RES (24)..(24): C-terminal alpha carboxylate replaced with amide
FTSEYSKYLDERRAKDFVCWLMNT

SEQ ID NO: 1515 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (19)..(19): Pegylated via spacer
  MOD_RES (24)..(24): C-terminal alpha carboxylate replaced with amide
FTSDYSKYLDERRAKDFVKWLMDT

SEQ ID NO: 1516 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated via rigid spacer
  MOD_RES (24)..(24): C-terminal alpha carboxylate replaced with amide
FTSDYSKYLDERRAKDFVKWLMDT

SEQ ID NO: 1517 - protein, 35 aa, Artificial Sequence
  Synthetic Polypeptide
  MISC_FEATURE (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDTGPGPGPGPGPC

SEQ ID NO: 1518 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate reaplaced with amide
FTSDYSKYLDERRAKDFVQWLMDGGPSSGAPPPSC

SEQ ID NO: 1519-1700 - skipped (182 entries)

SEQ ID NO: 1701 - protein, 29 aa, Artificial Sequence
  Synthetic peptide
  MOD_RES (2)..(2): Xaa is AIB
  misc_feature (16)..(16): Xaa can be any naturally occurring amino acid
  misc_feature (20)..(20): Xaa can be any naturally occurring amino acid
  MOD_RES (29)..(29): C-terminal amidation
HSQGTFTSDYSKYLDXQAAXGFIAWLMNT

SEQ ID NO: 1702 - protein, 29 aa, Artificial Sequence
  Synthetic peptide
  MOD_RES (2)..(2): Xaa is AIB
  MOD_RES (10)..(10): Acylated with C16 fatty acyl group
  MOD_RES (16)..(16): Xaa is AIB
  MOD_RES (29)..(29): C-terminal amidation
HXQGTFTSDKSKYLDXRAAQDFVQWLMDT

SEQ ID NO: 1703 - protein, 29 aa, Artificial Sequence
  Synthetic peptide
  MOD_RES (2)..(2): Xaa is AIB
  MOD_RES (10)..(10): Acylated with C14 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 1704 - protein, 29 aa, Artificial Sequence
  Synthetic peptide
  MOD_RES (2)..(2): Xaa is AIB
  MOD_RES (10)..(10): Acylated with C18 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 1705 - protein, 29 aa, Artificial Sequence
  Synthetic peptide
  MOD_RES (1)..(10): Acylated with C16 fatty acyl group via dipeptide spacer
  MOD_RES (2)..(2): Xaa is AIB
  MOD_RES (16)..(16): Xaa is AIB
  MOD_RES (29)..(29): C-terminal amidation
HXEGTFTSDKSKYLDXRAAQDFVQWLMDT

SEQ ID NO: 1706 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
HXQGTFISDKSKYLDXRAAQDFVQWLMDT

SEQ ID NO: 1707 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (29)..(29): C-terminal amidation
HXQGTFTSDKSKYLDERAAQDFVQWLMDT

SEQ ID NO: 1708 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
  MOD_RES (29)..(29): C-terminal amidation
HXQGTFTSDKSKYLEXRAAQDFVQWLMDT

SEQ ID NO: 1709 - protein, 29 aa, Artificial Sequence
  Synthetic peptide
  MOD_RES (2)..(2): d-Ser
  MOD_RES (10)..(10): Acylated with C16 fatty acyl group via dipeptide spacer
  MOD_RES (16)..(16): Xaa is AIB
  MOD_RES (29)..(29): C-terminal amidation
HSQGTFTSDKSKYLDXRAAQDFVQWLMDT

SEQ ID NO: 1710 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLLDT

SEQ ID NO: 1711 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (29)..(29): C-terminal amidation
HXQGTFTSDKSKYLDEQAAKEFIAWLLDT

SEQ ID NO: 1712 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (29)..(29): C-terminal amidation
HXQGTFTSDKSKYLDEQAAKEFICWLLDT

SEQ ID NO: 1713 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (24)..(24): PEGYLATION
  MOD_RES (29)..(29): C-terminal amidation
HXQGTFTSDKSKYLDEQAAKEFICWLLDT

SEQ ID NO: 1714 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (24)..(24): PEGYLATION
  MOD_RES (29)..(29): C-terminal amidation
HXQGTFTSDKSKYLDERAAQDFVCWLLDT

SEQ ID NO: 1715 - protein, 30 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (30)..(30): PEGYLATION
  MOD_RES (30)..(30): C-terminal amidation
HXQGTFTSDKSKYLDEQAAKEFIQWLLDTC

SEQ ID NO: 1716 - protein, 29 aa, Artificial Sequence
  Synthetic peptide
  MOD_RES (10)..(10): Acylated with C16 fatty acyl group via gamma-Glu spacer
  MOD_RES (24)..(24): PEGYLATION
  MOD_RES (29)..(29): C-terminal amidation
HAQGTFTSDKSKYLDERAAQDFVCWLLDT

SEQ ID NO: 1717 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (29)..(29): C-terminal amidation
HSQGTFTSDKSKYLDEQAAKEFICWLLDT

SEQ ID NO: 1718 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (29)..(29): C-terminal amidation
HSQGTFTSDKSKYLDERAAQDFVQWLLDT

SEQ ID NO: 1719 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (29)..(29): C-terminal amidation
HSQGTFTSDKSKYLDERAAQDFVCWLLDT

SEQ ID NO: 1720 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
HSQGTFTSDKSKYLDEQAAKEFICWLLDT

SEQ ID NO: 1721 - protein, 31 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (31)..(31): C-terminal amidation
HSQGTFTSDKSKYLDEQAAKEFICWLLDTGE

SEQ ID NO: 1722 - protein, 31 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
HSQGTFTSDKSKYLDEQAAKEFICWLLDTGG

SEQ ID NO: 1723 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
  MOD_RES (29)..(29): C-terminal amidation
HSQGTFTSDKSKYLDERAAQDFVCWLLDT

SEQ ID NO: 1724 - protein, 30 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (30)..(30): PEGYLATION
  MOD_RES (30)..(30): C-terminal amidation
HSQGTFTSDKSKYLDERAAQDFVQWLLDTC

SEQ ID NO: 1725 - protein, 30 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
  MOD_RES (30)..(30): C-terminal amidation
HSQGTFTSDYSKYLDSRRAQDFVQWLMNTE

SEQ ID NO: 1726 - protein, 30 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
HSQGTFTSDKSKYLDEQAAKEFICWLLDTC

SEQ ID NO: 1727 - protein, 29 aa, Artificial Sequence
  Synthetic peptide
  MOD_RES (1)..(1): Xaa is DMIA
  MOD_RES (10)..(10): Acylated with C16 fatty acyl group via gamma-Glu spacer
  MOD_RES (29)..(29): C-terminal amidation
XSQGTFTSDKSKYLDEQAAKEFICWLLDT

SEQ ID NO: 1728 - protein, 29 aa, Artificial Sequence
  Synthetic peptide
  MOD_RES (1)..(1): des-amino-His
  MOD_RES (10)..(10): Acylated with C16 fatty acyl group via gamma-Glu spacer
  MOD_RES (29)..(29): C-terminal amidation
HSQGTFTSDKSKYLDEQAAKEFICWLLDT

SEQ ID NO: 1729 - protein, 29 aa, Artificial Sequence
  Synthetic peptide
  MOD_RES (1)..(1): Ac-His
  MOD_RES (10)..(10): Acylated with C16 fatty acyl group via gamma-Glu spacer
  MOD_RES (24)..(24): PEGYLATION
  MOD_RES (29)..(29): C-terminal amidation
HSQGTFTSDKSKYLDEQAAKEFICWLLDT

SEQ ID NO: 1730 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (29)..(29): C-terminal amidation
HXQGTFTSDKSKYLDEEAVRLFIEWLMNT

SEQ ID NO: 1731 - protein, 29 aa, Artificial Sequence
  Synthetic peptide
  MOD_RES (2)..(2): Xaa is AIB
  MOD_RES (10)..(10): Acylated with C16 fatty acyl group
  MOD_RES (29)..(29): C-terminal amidation
HXQGTFTSDKSKYLDEEAVRLFIEWLMNT

SEQ ID NO: 1732 - protein, 29 aa, Artificial Sequence
  Synthetic peptide
  MOD_RES (2)..(2): Xaa is AIB
  MOD_RES (24)..(24): PEGYLATION
  MOD_RES (29)..(29): C-terminal amidation
HXQGTFTSDYSKYLDEEAVRLFICWLMNT

SEQ ID NO: 1733 - protein, 29 aa, Artificial Sequence
  Synthetic peptide
  MOD_RES (2)..(2): Xaa is AIB
  MOD_RES (29)..(29): C-terminal amidation
HXQGTFTSDYSKYLDEEAVRLFIEWLMNT

SEQ ID NO: 1734 - protein, 29 aa, Artificial Sequence
  Synthetic peptide
  MOD_RES (2)..(2): Xaa is AIB
  MOD_RES (29)..(29): C-terminal amidation
HXQGTFTSDYSKYLDEEAVRLFICWLMNT

SEQ ID NO: 1735 - protein, 29 aa, Artificial Sequence
  Synthetic peptide
  MOD_RES (2)..(2): d-Ser
  MOD_RES (24)..(24): PEGYLATION
  MOD_RES (29)..(29): C-terminal amidation
HSQGTFTSDYSKYLDEEAVRLFICWLMNT

SEQ ID NO: 1736 - protein, 29 aa, Artificial Sequence
  Synthetic peptide
  MOD_RES (2)..(2): d-Ser
  MOD_RES (29)..(29): C-terminal amidation
HSQGTFTSDYSKYLDEEAVRLFIEWLMNT

SEQ ID NO: 1737 - protein, 29 aa, Artificial Sequence
  Synthetic peptide
  MOD_RES (2)..(2): d-Ser
  MOD_RES (29)..(29): C-terminal amidation
HSQGTFTSDYSKYLDEEAVRLFICWLMNT

SEQ ID NO: 1738 - protein, 29 aa, Artificial Sequence
  Synthetic peptide
  MOD_RES (10)..(10): Acylated with C16 fatty acyl group via acidic amino acid spacer
  MOD_RES (29)..(29): C-terminal amidation
HSQGTFTSDKSKYLDEEAVRLFIEWLMNT

SEQ ID NO: 1739 - protein, 29 aa, Artificial Sequence
  Synthetic peptide
  MOD_RES (10)..(10): Acylated with C16 fatty acyl group via gamma-Glu spacer
  MOD_RES (29)..(29): C-terminal amidation
HSQGTFTSDKSKYLDEEAVRLFIEWLMNT

SEQ ID NO: 1740 - protein, 29 aa, Artificial Sequence
  Synthetic peptide
  MOD_RES (2)..(2): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HXQGTFTSDYSKYLDEKRAKEFVCWLMNT

SEQ ID NO: 1741 - protein, 29 aa, Artificial Sequence
  Synthetic peptide
  MOD_RES (2)..(2): Xaa is AIB
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HXQGTFTSDYSKYLDXKRAKEFVCWLMNT

SEQ ID NO: 1742 - protein, 29 aa, Artificial Sequence
  Synthetic peptide
  MOD_RES (2)..(2): d-Ser
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HSQGTFTSDYSKYLDEKRAKEFVCWLMNT

SEQ ID NO: 1743 - protein, 29 aa, Artificial Sequence
  Synthetic peptide
  MOD_RES (2)..(2): d-Ser
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HSQGTFTSDYSKYLDXKRAKEFVCWLMNT

SEQ ID NO: 1744 - protein, 29 aa, Artificial Sequence
  Synthetic peptide
  MOD_RES (2)..(2): d-Ser
  MISC_FEATURE (16)..(20): Salt bridge
  MISC_FEATURE (17)..(21): Salt bridge
  MOD_RES (29)..(29): C-terminal amidation
HSQGTFTSDYSKYLDEKRAKEFVQWLMNT

SEQ ID NO: 1745 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (16)..(16): Xaa is AIB
  MISC_FEATURE (16)..(20): Salt bridge
  MISC_FEATURE (17)..(21): Salt bridge
  MOD_RES (29)..(29): C-terminal amidation
HSQGTFTSDYSKYLDXKRAKEFVQWLMNT

SEQ ID NO: 1746 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via gamma-Glu spacer
  MISC_FEATURE (15)..(20): Salt bridge
  MOD_RES (16)..(16): Xaa is AIB
  MISC_FEATURE (16)..(21): Salt bridge
  MOD_RES (29)..(29): C-terminal amidation
HSQGTFTSDKSKYLDXKRAKEFVQWLMNT

SEQ ID NO: 1747 - protein, 29 aa, Artificial Sequence
  Synthetic peptide
  MOD_RES (1)..(1): Xaa is DMIA
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
XSQGTFTSDYSKYLDXKRAKEFVCWLMNT

SEQ ID NO: 1748 - protein, 29 aa, Artificial Sequence
  Synthetic peptide
  MISC_FEATURE (16)..(20): Salt bridge
  MISC_FEATURE (17)..(21): Salt bridge
  MOD_RES (29)..(29): C-terminal amidation
HSQGTFTSDYSKYLDEKRAKEFVQWLMNT

SEQ ID NO: 1749 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 1750 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (29)..(29): C-terminal amidation
HXQGTFTSDKSKYLDEQAAKEFICWLLDT

SEQ ID NO: 1751 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (24)..(24): PEGYLATION
  MOD_RES (29)..(29): C-terminal amidation
HXQGTFTSDKSKYLDEQAAKEFICWLLDT

SEQ ID NO: 1752 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (24)..(24): PEGYLATION
  MOD_RES (29)..(29): C-terminal amidation
HXQGTFTSDKSKYLDERAAQDFVCWLLDT

SEQ ID NO: 1753 - protein, 30 aa, Artificial Sequence; identical to SEQ ID NO: 1715
  Synthetic peptide
  MOD_RES (2)..(2): Xaa is AIB
  MOD_RES (10)..(10): Acylated with C16 fatty acyl group via acidic amino acid spacer
  MOD_RES (30)..(30): PEGYLATION
  MOD_RES (30)..(30): C-terminal amidation

SEQ ID NO: 1754 - protein, 29 aa, Artificial Sequence
  Synthetic peptide
  MOD_RES (10)..(10): Acylated with C16 fatty acyl group via acidic amino acid spacer
  MOD_RES (24)..(24): PEGYLATION
  MOD_RES (29)..(29): C-terminal amidation
HAQGTFTSDKSKYLDERAAQDFVCWLLDT

SEQ ID NO: 1755 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (29)..(29): C-terminal amidation
HXQGTFTSDKSKYLDEQAAKEFICWLLDT

SEQ ID NO: 1756 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (29)..(29): C-terminal amidation
HXQGTFTSDKSKYLDERAAQDFVQWLLDT

SEQ ID NO: 1757 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (29)..(29): C-terminal amidation
HXQGTFTSDKSKYLDERAAQDFVCWLLDT

SEQ ID NO: 1758 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
HXQGTFTSDKSKYLDEQAAKEFICWLLDT

SEQ ID NO: 1759 - protein, 31 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (31)..(31): C-terminal amidation
HXQGTFTSDKSKYLDEQAAKEFICWLLDTGE

SEQ ID NO: 1760 - protein, 31 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
HXQGTFTSDKSKYLDEQAAKEFICWLLDTGG

SEQ ID NO: 1761 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
  MOD_RES (29)..(29): C-terminal amidation
HXQGTFTSDKSKYLDERAAQDFVCWLLDT

SEQ ID NO: 1762 - protein, 30 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (30)..(30): PEGYLATION
  MOD_RES (30)..(30): C-terminal amidation
HXQGTFTSDKSKYLDERAAQDFVQWLLDTC

SEQ ID NO: 1763 - protein, 30 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
  MOD_RES (30)..(30): C-terminal amidation
HXQGTFTSDYSKYLDSRRAQDFVQWLMNTE

SEQ ID NO: 1764 - protein, 30 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
HXQGTFTSDKSKYLDEQAAKEFICWLLDTC

SEQ ID NO: 1765 - protein, 29 aa, Artificial Sequence
  Synthetic peptide
  MOD_RES (1)..(1): Xaa is DMIA
  MOD_RES (10)..(10): Acylated with C16 fatty acyl group via acidic amino acid spacer
  MOD_RES (29)..(29): C-terminal amidation
XSQGTFTSDKSKYLDEQAAKEFICWLLDT

SEQ ID NO: 1766 - protein, 29 aa, Artificial Sequence
  Synthetic peptide
  MOD_RES (1)..(1): des-amino-His
  MOD_RES (10)..(10): Acylated with C16 fatty acyl group via acidic amino acid spacer
  MOD_RES (29)..(29): C-terminal amidation
HSQGTFTSDKSKYLDEQAAKEFICWLLDT

SEQ ID NO: 1767 - protein, 29 aa, Artificial Sequence
  Synthetic peptide
  MOD_RES (1)..(1): Ac-His
  MOD_RES (10)..(10): Acylated with C16 fatty acyl group via acidic amino acid spacer
  MOD_RES (24)..(24): PEGYLATION
  MOD_RES (29)..(29): C-terminal amidation
HSQGTFTSDKSKYLDEQAAKEFICWLLDT

SEQ ID NO: 1768 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (29)..(29): C-terminal amidation
HXQGTFTSDKSKYLDEEAVRLFIEWLMNT

SEQ ID NO: 1769 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (24)..(24): PEGYLATION
  MOD_RES (29)..(29): C-terminal amidation
HXQGTFTSDYSKYLDEEAVRLFICWLMNT

SEQ ID NO: 1770 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (29)..(29): C-terminal amidation
HXQGTFTSDYSKYLDEEAVRLFIEWLMNT

SEQ ID NO: 1771 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (29)..(29): C-terminal amidation
HXQGTFTSDYSKYLDEEAVRLFICWLMNT

SEQ ID NO: 1772 - protein, 29 aa, Artificial Sequence
  Synthetic peptide
  MOD_RES (10)..(10): Acylated with C16 fatty acyl group via acidic amino acid spacer
  MOD_RES (29)..(29): C-terminal amidation
HSQGTFTSDKSKYLDEEAVRLFIEWLMNT

SEQ ID NO: 1773 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HXQGTFTSDYSKYLDEKRAKEFVCWLMNT

SEQ ID NO: 1774 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HSQGTFTSDYSKYLDXKRAKEFVCWLMNT

SEQ ID NO: 1775 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MISC_FEATURE (16)..(20): Salt bridge
  MISC_FEATURE (17)..(21): Salt bridge
  MOD_RES (29)..(29): C-terminal amidation
HSQGTFTSDYSKYLDEKRAKEFVQWLMNT

SEQ ID NO: 1776 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MISC_FEATURE (15)..(20): Salt bridge
  MOD_RES (16)..(16): Xaa is AIB
  MISC_FEATURE (16)..(21): Salt bridge
  MOD_RES (29)..(29): C-terminal amidation
HSQGTFTSDKSKYLDXKRAKEFVQWLMNT

SEQ ID NO: 1777-1800 - skipped (24 entries)

SEQ ID NO: 1801 - protein, 37 aa, Homo sapiens
HSQGTFTSDYSKYLDSRRAQDFVQWLMNTKRNRNNIA

SEQ ID NO: 1802 - protein, 37 aa, Artificial Sequence
  OXM analog
HSEGTFTSDYSKYLDSRRAQDFVQWLMNTKRNRNNIA

SEQ ID NO: 1803 - protein, 37 aa, Artificial Sequence
  OXM analog
HSDGTFTSDYSKYLDSRRAQDFVQWLMNTKRNRNNIA

SEQ ID NO: 1804 - protein, 38 aa, Artificial Sequence
  OXM analog
  MOD_RES (2)..(2): Xaa=Aminoisobutyric acid
  MOD_RES (38)..(38): C-terminal amidation
HXQGTFTSDYSKYLDSRRAQDFVQWLMNTKRNRNNIAC

SEQ ID NO: 1805 - protein, 38 aa, Artificial Sequence
  OXM analog
  MOD_RES (2)..(2): Xaa=D-serine
  MOD_RES (38)..(38): Xaa=Cys(mPEG)5kDa
  MOD_RES (38)..(38): C-terminal amidation
HXQGTFTSDYSKYLDSRRAQDFVQWLMNTKRNRNNIAX

SEQ ID NO: 1806 - protein, 38 aa, Artificial Sequence; identical to SEQ ID NO: 1805
  OXM analog
  MOD_RES (2)..(2): Xaa=D-serine
  MOD_RES (38)..(38): Xaa=Cys(mPEG)20kDa
  MOD_RES (38)..(38): C-terminal amidation

SEQ ID NO: 1807 - protein, 38 aa, Artificial Sequence; identical to SEQ ID NO: 1805
  OXM analog
  MOD_RES (2)..(2): Xaa=D-serine
  MOD_RES (38)..(38): Xaa=Cys(mPEG)2 40kDa
  MOD_RES (38)..(38): C-terminal amidation

SEQ ID NO: 1808 - protein, 38 aa, Artificial Sequence; identical to SEQ ID NO: 1805
  OXM analog
  MOD_RES (2)..(2): Xaa=D-serine
  MOD_RES (38)..(38): Xaa=Cys(9cholest-5-en-3-yl{[(2R)-3-amino-2-(amino) -3-oxopropyl]thio}acetate)
  MOD_RES (38)..(38): C-terminal amidation

SEQ ID NO: 1809 - protein, 38 aa, Artificial Sequence; identical to SEQ ID NO: 1805
  OXM analog
  MOD_RES (2)..(2): Xaa=Aminoisobutyric acid
  MOD_RES (38)..(38): Xaa=Cys(mPEG)5kDa
  MOD_RES (38)..(38): C-terminal amidation

SEQ ID NO: 1810 - protein, 38 aa, Artificial Sequence; identical to SEQ ID NO: 1805
  OXM analog
  MOD_RES (2)..(2): Xaa=aminoisobutyric acid
  MOD_RES (38)..(38): Xaa=Cys(mPEG)20kDa
  MOD_RES (38)..(38): C-terminal amidation

SEQ ID NO: 1811 - protein, 38 aa, Artificial Sequence; identical to SEQ ID NO: 1805
  OXM analog
  MOD_RES (2)..(2): X=aminoisobutyric acid
  MOD_RES (38)..(38): Xaa=Cys(mPEG)2 40kDa
  MOD_RES (38)..(38): C-terminal amidation

SEQ ID NO: 1812 - protein, 38 aa, Artificial Sequence; identical to SEQ ID NO: 1805
  OXM analog
  MOD_RES (2)..(2): Xaa=aminoisobutyric acid
  MOD_RES (38)..(38): Xaa=Cys(cholest-5-en-3-yl{[(2R)-3-amino-2-(amino)- 3-oxopropyl]thio}acetate)
  MOD_RES (38)..(38): C-terminal amidation

SEQ ID NO: 1813 - protein, 38 aa, Artificial Sequence
  OXM analog
  MOD_RES (2)..(2): Xaa=aminoisobutyric acid
  MOD_RES (27)..(27): Xaa=methionine sulfoxide
  MOD_RES (38)..(38): Xaa=Cys(mPEG)240kDa
  MOD_RES (38)..(38): C-terminal amidation
HXQGTFTSDYSKYLDSRRAQDFVQWLXNTKRNRNNIAX

SEQ ID NO: 1814 - protein, 38 aa, Artificial Sequence; identical to SEQ ID NO: 1813
  OXM analog
  MOD_RES (2)..(2): Xaa=Aib
  MOD_RES (27)..(27): Xaa=methionine sulfoxide
  MOD_RES (38)..(38): Xaa=Cys(mPEG)260kDa
  MOD_RES (38)..(38): C-terminal amidation

SEQ ID NO: 1815 - protein, 37 aa, Artificial Sequence
  OXM analog
  MOD_RES (2)..(2): Xaa=Aib
  MOD_RES (20)..(20): Xaa=Cys(mPEG)240kDa
  MOD_RES (37)..(37): C-terminal amidation
HXQGTFTSDYSKYLDSRRAXDFVQWLMNTKRNRNNIA

SEQ ID NO: 1816 - protein, 37 aa, Artificial Sequence
  OXM analog
  MOD_RES (2)..(2): Xaa=Aib
  MOD_RES (21)..(21): Xaa=Cys(mPEG)240kDa
  MOD_RES (37)..(37): C-terminal amidation
HXQGTFTSDYSKYLDSRRAQXFVQWLMNTKRNRNNIA

SEQ ID NO: 1817 - protein, 37 aa, Artificial Sequence
  OXM analog
  MOD_RES (2)..(2): Aib
  MOD_RES (24)..(24): Xaa=Cys(mPEG)240kDa
  MOD_RES (27)..(27): Xaa=metionine sulfoxide
  MOD_RES (37)..(37): C-terminal amidation
HXQGTFTSDYSKYLDSRRAQDFVXWLXNTKRNRNNIA

SEQ ID NO: 1818 - protein, 37 aa, Artificial Sequence
  OXM analog
  MOD_RES (2)..(2): Xaa=Aib
  MOD_RES (28)..(28): Xaa=Cys(mPEG)240kDa
  MOD_RES (37)..(37): C-terminal amidation
HXQGTFTSDYSKYLDSRRAQDFVQWLMXTKRNRNNIA

SEQ ID NO: 1819 - protein, 38 aa, Artificial Sequence; identical to SEQ ID NO: 1805
  OXM analog
  MOD_RES (2)..(2): Xaa=D-serine
  MOD_RES (38)..(38): Xaa=Lys(palmitoyl)
  MOD_RES (38)..(38): C-terminal amidation

SEQ ID NO: 1820 - protein, 38 aa, Artificial Sequence
  OXM analog
  MOD_RES (1)..(1): Xaa=desamino-His (deltaNH2-H)
  MOD_RES (2)..(2): Xaa=Aib
  MOD_RES (27)..(27): Xaa=mrtionine sulfoxide
  MOD_RES (38)..(38): Xaa=Cys(mPEG)240kDa
  MOD_RES (38)..(38): C-terminal amidation
XXQGTFTSDYSKYLDSRRAQDFVQWLXNTKRNRNNIAX

SEQ ID NO: 1821 - protein, 38 aa, Artificial Sequence; identical to SEQ ID NO: 1805
  OXM analog
  MOD_RES (2)..(2): xaa=D-serine
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (38)..(38): C-terminal amidation

SEQ ID NO: 1822 - protein, 37 aa, Artificial Sequence
  OXM analog
  MOD_RES (2)..(2): Xaa=Aib
  MOD_RES (11)..(11): Xaa=Cys(mPEG)240kDa
  MOD_RES (27)..(27): Xaa=methionine sulfoxide
  MOD_RES (37)..(37): C-terminal amidation
HXQGTFTSDYXKYLDSRRAQDFVQWLXNTKRNRNNIA

SEQ ID NO: 1823 - protein, 37 aa, Artificial Sequence
  OXM analog
  MOD_RES (2)..(2): Xaa=Aib
  MOD_RES (12)..(12): Xaa=Cys(mPEG)240kDa
  MOD_RES (27)..(27): Xaa=Methionine sulfoxide
  MOD_RES (37)..(37): C-terminal amidation
HXQGTFTSDYSXYLDSRRAQDFVQWLXNTKRNRNNIA

SEQ ID NO: 1824 - protein, 38 aa, Artificial Sequence; identical to SEQ ID NO: 1805
  OXM analog
  MOD_RES (2)..(2): Xaa=Aib
  MOD_RES (38)..(38): Xaa=Lys(palmitoyl)
  MOD_RES (38)..(38): C-terminal amidation

SEQ ID NO: 1825 - protein, 38 aa, Artificial Sequence
  OXM analog
  MOD_RES (2)..(2): Xaa=Aib
  MOD_RES (27)..(27): Xaa=Nle
  MOD_RES (38)..(38): C-terminal amidation
HXQGTFTSDYSKYLDSRRAQDFVQWLXNTKRNRNNIAC

SEQ ID NO: 1826 - protein, 38 aa, Artificial Sequence; identical to SEQ ID NO: 1825
  OXM analog
  MOD_RES (2)..(2): Xaa=Aib
  MOD_RES (27)..(27): Xaa=O-methyl-L-homoserine
  MOD_RES (38)..(38): C-terminal amidation

SEQ ID NO: 1827 - protein, 38 aa, Artificial Sequence; identical to SEQ ID NO: 1813
  OXM analog
  MOD_RES (2)..(2): Xaa=Aib
  MOD_RES (27)..(27): Xaa=Nle
  MOD_RES (38)..(38): Xaa=Cys(cholest-5-en-3-yl{[(2R)-3-amino-2-(amino)- 3-oxopropyl]thio}acetate)
  MOD_RES (38)..(38): C-terminal amidation

SEQ ID NO: 1828 - protein, 38 aa, Artificial Sequence; identical to SEQ ID NO: 1813
  OXM analog
  MOD_RES (2)..(2): Xaa=Aib
  MOD_RES (27)..(27): Xaa=O-methyl-L-homoserine
  MOD_RES (38)..(38): Xaa=Cys(cholest-5-en-3-yl{[(2R)-3-amino-2-(amino)- 3-oxopropyl]thio}acetate)
  MOD_RES (38)..(38): C-terminal amidation

SEQ ID NO: 1829 - protein, 38 aa, Artificial Sequence; identical to SEQ ID NO: 1805
  OXM analog
  MOD_RES (2)..(2): Xaa=Aib
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (38)..(38): C-terminal amidation

SEQ ID NO: 1830 - protein, 38 aa, Artificial Sequence; identical to SEQ ID NO: 1804
  OXM analog
  MOD_RES (2)..(2): Xaa=D-serine
  MOD_RES (38)..(38): C-terminal amidation

SEQ ID NO: 1831 - protein, 38 aa, Artificial Sequence; identical to SEQ ID NO: 1813
  OXM analog
  MOD_RES (2)..(2): Xaa=D-serine
  MOD_RES (27)..(27): Xaa=metionine sulfoxide
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (38)..(38): C-terminal amidation

SEQ ID NO: 1832 - protein, 38 aa, Artificial Sequence; identical to SEQ ID NO: 1813
  OXM analog
  MOD_RES (2)..(2): Xaa=D-serine
  MOD_RES (27)..(27): Xaa=methionine sulfoxide
  MOD_RES (38)..(38): Xaa=Cys(CH2CONH2)
  MOD_RES (38)..(38): C-terminal amidation

SEQ ID NO: 1833 - protein, 37 aa, Artificial Sequence
  OXM analog
  MOD_RES (2)..(2): Xaa=1-Amino-1-cyclohexane carboxylic acid
  MOD_RES (37)..(37): C-terminal amidation
HXQGTFTSDYSKYLDSRRAQDFVQWLMNTKRNRNNIA

SEQ ID NO: 1834 - protein, 37 aa, Artificial Sequence; identical to SEQ ID NO: 1833
  OXM analog
  MOD_RES (2)..(2): Xaa=Abu
  MOD_RES (37)..(37): C-terminal amidation

SEQ ID NO: 1835 - protein, 37 aa, Artificial Sequence; identical to SEQ ID NO: 1833
  OXM analog
  MOD_RES (2)..(2): Xaa=D-abu
  MOD_RES (37)..(37): C-terminal amidation

SEQ ID NO: 1836 - protein, 37 aa, Artificial Sequence; identical to SEQ ID NO: 1833
  OXM analog
  MOD_RES (2)..(2): Xaa=Nva (Aminovaleric acid)
  MOD_RES (37)..(37): C-terminal amidation

SEQ ID NO: 1837 - protein, 37 aa, Artificial Sequence; identical to SEQ ID NO: 1833
  OXM analog
  MOD_RES (2)..(2): Xaa= beta-cyclopropyl-alanine
  MOD_RES (37)..(37): C-terminal amidation

SEQ ID NO: 1838 - protein, 37 aa, Artificial Sequence; identical to SEQ ID NO: 1833
  OXM analog
  MOD_RES (2)..(2): Xaa=propargylglycine
  MOD_RES (37)..(37): C-terminal amidation

SEQ ID NO: 1839 - protein, 37 aa, Artificial Sequence; identical to SEQ ID NO: 1833
  OXM analog
  MOD_RES (2)..(2): Xaa=Allylglycine
  MOD_RES (37)..(37): C-terminal amidation

SEQ ID NO: 1840 - protein, 37 aa, Artificial Sequence; identical to SEQ ID NO: 1833
  OXM analog
  MOD_RES (2)..(2): Xaa=2-Amino-2-cyclohexyl-propanoic acid
  MOD_RES (37)..(37): C-terminal amidation

SEQ ID NO: 1841 - protein, 37 aa, Artificial Sequence; identical to SEQ ID NO: 1833
  OXM analog
  MOD_RES (2)..(2): Xaa=D-tertbutylglycine
  MOD_RES (37)..(37): C-terminal amidation

SEQ ID NO: 1842 - protein, 37 aa, Artificial Sequence; identical to SEQ ID NO: 1833
  OXM analog
  MOD_RES (2)..(2): Xaa=Vinylglycine
  MOD_RES (37)..(37): C-terminal amidation

SEQ ID NO: 1843 - protein, 37 aa, Artificial Sequence; identical to SEQ ID NO: 1833
  OXM analog
  MOD_RES (2)..(2): Xaa=1-Amino-1-cyclopropane carboxylic acid
  MOD_RES (37)..(37): C-terminal amidation

SEQ ID NO: 1844 - protein, 37 aa, Artificial Sequence; identical to SEQ ID NO: 1833
  OXM analog
  MOD_RES (2)..(2): Xaa=1-Amino-1-cyclobutane carboxylic acid
  MOD_RES (37)..(37): C-terminal amidation

SEQ ID NO: 1845 - protein, 37 aa, Artificial Sequence; identical to SEQ ID NO: 1833
  OXM analog
  MOD_RES (2)..(2): Xaa=1-Amino-1-cyclopentane carboxylic acid
  MOD_RES (37)..(37): C-terminal amidation

SEQ ID NO: 1846 - protein, 38 aa, Artificial Sequence
  OXM analog
  MOD_RES (2)..(2): Xaa=D-serine
  MOD_RES (38)..(38): C-terminal amidation
HXQGTFTSDYSKYLDSEAAQDFVQWLMNTKRNRNNIAC

SEQ ID NO: 1847 - protein, 31 aa, Artificial Sequence
  OXM analog
  MOD_RES (2)..(2): Xaa=D-serine
  MOD_RES (31)..(31): C-terminal amidation
HXQGTFTSDYSKYLDSRRAQDFVQWLMNTKC

SEQ ID NO: 1848 - protein, 31 aa, Artificial Sequence
  OXM analog
  MOD_RES (2)..(2): Xaa=D-serine
  MOD_RES (31)..(31): C-terminal amidation
HXQGTFTSDYSKYLDSEAAQDFVQWLMNTKC

SEQ ID NO: 1849 - protein, 31 aa, Artificial Sequence
  OXM analog
  MOD_RES (2)..(2): Xaa=D-serine
  MOD_RES (31)..(31): C-terminal amidation
HXQGTFTSDYSKYLDSERAQDFVQWLMNTKC

SEQ ID NO: 1850 - protein, 31 aa, Artificial Sequence
  OXM analog
  MOD_RES (2)..(2): Xaa=D-serine
  MOD_RES (31)..(31): C-terminal amidation
HXQGTFTSDYSKYLDSRAAQDFVQWLMNTKC

SEQ ID NO: 1851 - protein, 38 aa, Artificial Sequence
  OXM analog
  MOD_RES (2)..(2): Xaa=D-serine
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (38)..(38): C-terminal amidation
HXQGTFTSDYSKYLDSEAAQDFVQWLMNTKRNRNNIAX

SEQ ID NO: 1852 - protein, 31 aa, Artificial Sequence
  OXM analog
  MOD_RES (2)..(2): Xaa=D-serine
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation
HXQGTFTSDYSKYLDSRRAQDFVQWLMNTKX

SEQ ID NO: 1853 - protein, 31 aa, Artificial Sequence
  OXM analog
  MOD_RES (2)..(2): X=D-serine
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation
HXQGTFTSDYSKYLDSEAAQDFVQWLMNTKX

SEQ ID NO: 1854 - protein, 31 aa, Artificial Sequence
  OXM analog
  MOD_RES (2)..(2): Xaa=D-serine
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation
HXQGTFTSDYSKYLDSERAQDFVQWLMNTKX

SEQ ID NO: 1855 - protein, 31 aa, Artificial Sequence
  OXM analog
  MOD_RES (2)..(2): Xaa=D-serine
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation
HXQGTFTSDYSKYLDSRAAQDFVQWLMNTKX

SEQ ID NO: 1856 - protein, 31 aa, Artificial Sequence; identical to SEQ ID NO: 1852
  OXM analog
  MOD_RES (2)..(2): Xaa=D-serine
  MOD_RES (31)..(31): Xaa=Lys(Palmitoyl)
  MOD_RES (31)..(31): C-terminal amidation

SEQ ID NO: 1857 - protein, 31 aa, Artificial Sequence; identical to SEQ ID NO: 1853
  OXM analog
  MOD_RES (2)..(2): Xaa=D-serine
  MOD_RES (31)..(31): Xaa=Lys(palmitoyl)
  MOD_RES (31)..(31): C-terminal amidation

SEQ ID NO: 1858 - protein, 32 aa, Artificial Sequence
  OXM analog
  MOD_RES (2)..(2): Xaa=D-serine
  MOD_RES (31)..(31): Xaa=Ttds
  MOD_RES (32)..(32): Xaa=Lys(Palmitoyl)
  MOD_RES (32)..(32): C-terminal amidation
HXQGTFTSDYSKYLDSRRAQDFVQWLMNTKXX

SEQ ID NO: 1859 - protein, 32 aa, Artificial Sequence
  OXM analog
  MOD_RES (2)..(2): Xaa=D-serine
  MOD_RES (31)..(31): Xaa=Ttds
  MOD_RES (32)..(32): Xaa=Lys(Palmitoyl)
  MOD_RES (32)..(32): C-terminal amidation
HXQGTFTSDYSKYLDSEAAQDFVQWLMNTKXX

SEQ ID NO: 1860 - protein, 32 aa, Artificial Sequence; identical to SEQ ID NO: 1858
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl{[(2R)-3-amino-2-(amino)- 3-oxopropyl]thio}acetate)
  MOD_RES (32)..(32): C-terminal amidation

SEQ ID NO: 1861 - protein, 32 aa, Artificial Sequence; identical to SEQ ID NO: 1859
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl{[(2R)-3-amino-2-(amino)- 3-oxopropyl]thio}acetate)
  MOD_RES (32)..(32): C-terminal amidation

SEQ ID NO: 1862 - protein, 31 aa, Artificial Sequence; identical to SEQ ID NO: 1853
  OXM analog
  MOD_RES (2)..(2): Xaa=Aib
  MOD_RES (31)..(31): Xaa= Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation

SEQ ID NO: 1863 - protein, 39 aa, Artificial Sequence
  OXM analog
  MOD_RES (2)..(2): Xaa=D-serine
  MOD_RES (38)..(38): Xaa=gamma glutamic acid
  MOD_RES (39)..(39): Xaa=Cys(cholest-5-en-3-yl{[(2R)-3-amino-2-(amino)- 3-oxopropyl]thio}acetate)
  MOD_RES (39)..(39): C-terminal amidation
HXQGTFTSDYSKYLDSEAAQDFVQWLMNTKRNRNNIAXX

SEQ ID NO: 1864 - protein, 32 aa, Artificial Sequence
  OXM analog
  MOD_RES (2)..(2): Xaa=D-serine
  MOD_RES (32)..(32): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (32)..(32): C-terminal amidation
HXQGTFTSDYSKYLDSEAAQDFVQWLMNTKRX

SEQ ID NO: 1865 - protein, 38 aa, Artificial Sequence; identical to SEQ ID NO: 1851
  OXM analog
  MOD_RES (2)..(2): Xaa=D-serine
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))

SEQ ID NO: 1866 - protein, 31 aa, Artificial Sequence; identical to SEQ ID NO: 1854
  OXM analog
  MOD_RES (2)..(2): Xaa=Aib
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation

SEQ ID NO: 1867 - protein, 32 aa, Artificial Sequence; identical to SEQ ID NO: 1858
  OXM analog
  MOD_RES (2)..(2): Xaa=Aib
  MOD_RES (31)..(31): Xaa=gamma glutamic acid
  MOD_RES (32)..(32): Xaa=Cys(cholest-5-en-3-yl{[(2R)-3-amino-2-(amino)- 3-oxopropyl]thio}acetate)

SEQ ID NO: 1868 - protein, 39 aa, Artificial Sequence; identical to SEQ ID NO: 1863
  OXM analog
  MOD_RES (2)..(2): Xaa=D-serine
  MOD_RES (38)..(38): Xaa=gamma glutamic acid
  MOD_RES (39)..(39): Xaa=Lys(Palmitoyl)
  MOD_RES (39)..(39): C-terminal amidation

SEQ ID NO: 1869 - protein, 33 aa, Artificial Sequence
  OXM analog
  MOD_RES (2)..(2): Xaa=D-serine
  MOD_RES (31)..(32): Xaa=gamma glutamic acid
  MOD_RES (33)..(33): Xaa=Cys(cholest-5-en-3-yl{[(2R)-3-amino-2-(amino)- 3-oxopropyl]thio}acetate)
HXQGTFTSDYSKYLDSRRAQDFVQWLMNTKXXX

SEQ ID NO: 1870 - protein, 32 aa, Artificial Sequence
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1{[(2R)-3-amino-2-(amino)-3-oxopropyl]thio}acetate )
HXQGTFTSDYSSYLDSRRAQDFVQWLMNTKXX

SEQ ID NO: 1871 - protein, 32 aa, Artificial Sequence
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1{[(2R)-3-amino-2-(amino)-3-oxopropyl]thio}acetate );
HXQGTFTSDYSKYLDSRAAQDFVQWLMNTKXX

SEQ ID NO: 1872 - protein, 32 aa, Artificial Sequence; identical to SEQ ID NO: 1870
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1873 - protein, 32 aa, Artificial Sequence; identical to SEQ ID NO: 1871
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1874 - protein, 32 aa, Artificial Sequence
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1{[(2R)-3-amino-2-(amino)-3-oxopropyl]thio}acetate )
HXQGTFTSDYSKYLDERRAQDFVQWLMNTKXX

SEQ ID NO: 1875 - protein, 32 aa, Artificial Sequence; identical to SEQ ID NO: 1874
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1876 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1877 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=S-{1-[46-(cholest-5-en-3-yloxy)-3,43,46-trioxo -7,10,13,16,19,22,25,28,31,34,37,40-dodecaoxa-4,44 -diazahexatetracont-1-yl]-2,5-dioxopyrrolidin-3-yl }-L-cysteine or Cys (mal-oxa12-cholesterol)

SEQ ID NO: 1878 - protein, 33 aa, Artificial Sequence; identical to SEQ ID NO: 1869
  OXM analog
  MOD_RES (2)..(2): Xaa=Aib
  MOD_RES (31)..(32): Xaa=gamma glutamic acid
  MOD_RES (33)..(33): Xaa== Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1879 - protein, 33 aa, Artificial Sequence; identical to SEQ ID NO: 1869
  OXM analog
  MOD_RES (2)..(2): Xaa=1-Amino-1-cyclobutane carboxylic acid
  MOD_RES (31)..(32): Xaa=gamma glutamic acid
  MOD_RES (33)..(33): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1880 - protein, 33 aa, Artificial Sequence
  OXM analog
  MOD_RES (2)..(2): Xaa=D-serine
  MISC_FEATURE (16)..(20): Lactam bridge between side chains
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)
HXQGTFTSDYSKYLDERRAKDFVQWLMNTKXXX

SEQ ID NO: 1881 - protein, 33 aa, Artificial Sequence; identical to SEQ ID NO: 1880
  OXM analog
  MOD_RES (2)..(2): Xaa=Aib
  MISC_FEATURE (16)..(20): Lactam bridge between side chains
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1882 - protein, 33 aa, Artificial Sequence; identical to SEQ ID NO: 1880
  OXM analog
  MOD_RES (2)..(2): Xaa=1-Amino-1-cyclobutane carboxylic acid
  MISC_FEATURE (16)..(20): Lactam bridge between side chains
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1883 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1884 - protein, 33 aa, Artificial Sequence; identical to SEQ ID NO: 1869
  OXM analog
  MOD_RES (2)..(2): Xaa=Aib
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1885 - protein, 33 aa, Artificial Sequence; identical to SEQ ID NO: 1869
  OXM analog
  MOD_RES (2)..(2): Xaa=1-Amino-1-cyclobutane carboxylic acid
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1886 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=Lys(gamma-glutamic acid-palmitoyl)
  MOD_RES (33)..(33): C-terminal amidation

SEQ ID NO: 1887 - protein, 33 aa, Artificial Sequence
  OXM analog
  MOD_RES (2)..(2): Xaa=D-serine
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)
  MOD_RES (33)..(33): C-terminal amidation
HXQGTFTSDYSKYLDERRAQDFVQWLMNTKXXX

SEQ ID NO: 1888 - protein, 32 aa, Artificial Sequence
  OXM analog
  MOD_RES (2)..(2): Xaa=D-serine
  MOD_RES (20)..(20): Xaa=Lys(gamma-glutamic acid-palmitoyl)
  MOD_RES (31)..(32): Xaa=gamma glutamic acid
  MOD_RES (32)..(32): C-terminal amidation
HXQGTFTSDYSKYLDSRRAXDFVQWLMNTKXX

SEQ ID NO: 1889 - protein, 31 aa, Artificial Sequence
  OXM analog
  MOD_RES (2)..(2): Xaa=D-serine
  MOD_RES (20)..(20): Xaa=Lys(gamma-glutamic acid-gamma-glutamic acid-palmitoyl)
  MOD_RES (31)..(31): Xaa=gamma glutamic acid
  MOD_RES (31)..(31): C-terminal amidation
HXQGTFTSDYSKYLDSRRAXDFVQWLMNTKX

SEQ ID NO: 1890 - protein, 30 aa, Artificial Sequence
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (30)..(30): C-terminal amidation
HXQGTFTSDXSKYLDSRRAQDFVQWLMNTK

SEQ ID NO: 1891 - protein, 30 aa, Artificial Sequence
  OXM analog
  MOD_RES (2)..(2): Xaa=D-serine
  MOD_RES (20)..(20): Xaa=Lys(gamma-glutamic acid-gamma-glutamic acid-palmitoyl)
  MOD_RES (30)..(30): C-terminal amidation
HXQGTFTSDYSKYLDERRAXDFVQWLMNTK

SEQ ID NO: 1892 - protein, 30 aa, Artificial Sequence
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (30)..(30): C-terminal amidation
HXQGTFTSDXSKYLDERRAQDFVQWLMNTK

SEQ ID NO: 1893 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=S-[78-(cholest-5-en-3-yloxy)-2,78-dioxo-6,9,12 ,15,18,21,24,27,30,33,36,39,42,45,48,51,54,57,60,6 3,66,69,72,75-tetracosaoxa-3-azaoctaheptacont-1-yl ]-L-cysteine or Cys (oxa24-cholesterol)

SEQ ID NO: 1894 - protein, 33 aa, Artificial Sequence
  OXM analog
  MOD_RES (2)..(2): Xaa=Aib
  MOD_RES (24)..(24): Xaa=Lys(DOTA)
  MOD_RES (27)..(27): Xaa=methionine sulfoxide
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)
  MOD_RES (33)..(33): C-terminal amidation
HXDGTFTSDYSKYLDSRRAQDFVXWLXNTKXXX

SEQ ID NO: 1895 - protein, 31 aa, Artificial Sequence
  OXM analog
  MOD_RES (2)..(2): Xaa=D-serine
  MOD_RES (10)..(10): Xaa=Lys(gamma glutamic acid-palmitoyl)
  MOD_RES (31)..(31): Xaa=gamma glutamic acid
  MOD_RES (31)..(31): C-terminal amidation
HXQGTFTSDXSKYLDERRAQDFVQWLMNTKX

SEQ ID NO: 1896 - protein, 32 aa, Artificial Sequence
  OXM analog
  MOD_RES (2)..(2): Xaa=D-serine
  MOD_RES (10)..(10): Xaa=Lys(palmitoyl)
  MOD_RES (31)..(32): Xaa=gamma glutamic acid
  MOD_RES (32)..(32): C-terminal amidation
HXQGTFTSDXSKYLDERRAQDFVQWLMNTKXX

SEQ ID NO: 1897 - protein, 30 aa, Artificial Sequence; identical to SEQ ID NO: 1892
  OXM analog
  MOD_RES (2)..(2): Xaa=aib
  MOD_RES (10)..(10): Xaa=Lys(gamma-glutamic acid-gamma glutamic acid-palmitoyl)
  MOD_RES (30)..(30): C-terminal amidation

SEQ ID NO: 1898 - protein, 30 aa, Artificial Sequence; identical to SEQ ID NO: 1892
  OXM analog
  MOD_RES (2)..(2): Xaa=acb
  MOD_RES (10)..(10): Xaa=Lys(gamma-glutamic acid-gamma-glutamic acid-palmitoyl
  MOD_RES (30)..(30): C-terminal amidation

SEQ ID NO: 1899 - protein, 31 aa, Artificial Sequence; identical to SEQ ID NO: 1895
  OXM analog
  MOD_RES (2)..(2): Xaa=D-Serine
  MOD_RES (10)..(10): Xaa=Lys(gamma-glutamic acid-gamma-glutamic acid-palmitoyl
  MOD_RES (16)..(16): Xaa=aib
  MOD_RES (31)..(31): Xaa=gamma glutamic acid
  MOD_RES (31)..(31): C-terminal amidation

SEQ ID NO: 1900 - protein, 33 aa, Artificial Sequence; identical to SEQ ID NO: 1869
  OXM analog
  MOD_RES (2)..(2): Xaa=aib
  MOD_RES (31)..(32): Xaa=gamma glutamic acid
  MOD_RES (33)..(33): Xaa=Lys(gamma glutamic acid-palmitoyl)
  MOD_RES (33)..(33): C-terminal amidation

SEQ ID NO: 1901 - protein, 33 aa, Artificial Sequence; identical to SEQ ID NO: 1869
  OXM analog
  MOD_RES (2)..(2): Xaa=acb
  MOD_RES (31)..(32): Xaa=gamma glutamic acid
  MOD_RES (33)..(33): Xaa=Lys(gamma glutamic acid-palmitoyl)
  MOD_RES (33)..(33): C-terminal amidation

SEQ ID NO: 1902 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=S-[38-(cholest-5-en-3-yloxy)-2-oxo-6,9,12,15,1 8,21,24,27,30,33,36-undecaoxa-3-azaoctatriacont-1- yl]-L-cysteine or Cys (oxa12-O-cholesterol)

SEQ ID NO: 1903 - protein, 30 aa, Artificial Sequence
  OXM analog
  VARIANT (2)..(2): Xaa=D-serine or Aib;
  VARIANT (17)..(17): Xaa=Arg or Glu
  VARIANT (18)..(18): Xaa=Arg or Ala
  VARIANT (27)..(27): Xaa=methionine, norleucine, or O-methyl-L-homoserine
HXQGTFTSDYSKYLDSXXAQDFVQWLXNTK

SEQ ID NO: 1904 - protein, 7 aa, Artificial Sequence
  OXM peptide
RNRNNIA

SEQ ID NO: 1905 - protein, 37 aa, Artificial Sequence
  OXM analog
  VARIANT (2)..(2): Xaa=D-serine; Aib; Acb; 1-Amino-1-cyclohexane carboxylic acid (Acx); alpha-aminobutyric acid(Abu); D- alpha-aminobutyric acid (D-Abu); Aminovaleric acid Nva); beta-cyclopropyl-alanine (Cpa); propargylglycine (Prg); Allylglycine (Alg);
  VARIANT (17)..(17): Xaa=Arg or Glu
  VARIANT (18)..(18): Xaa=Arg or Ala
  VARIANT (27)..(27): Xaa=methionine (M), norleucine (Nle), methionine sulfoxide (m) or O-methyl-L-homoserine (o)
HXQGTFTSDYSKYLDSXXAQDFVQWLXNTKRNRNNIA

SEQ ID NO: 1906 - protein, 37 aa, Artificial Sequence
  OXM analog
  VARIANT (2)..(2): Xaa = D-Ser,  Aib,  Acb, Acx,  Abu, D-Abu, Aminovaleric acid (Nva), Cpa, Prg, Alg, 2-Cha, D-tbg, Vg, Acp, or Acpe
  VARIANT (12)..(12): Xaa=Ser or Lys
  VARIANT (16)..(16): Xaa=Ser or Glu
  VARIANT (17)..(17): Xaa=Arg or Glu
  VARIANT (18)..(18): Xaa=Arg or Ala
  VARIANT (20)..(20): Xaa=Gln or Lys
  VARIANT (27)..(27): Xaa=a methionine, norleucine, methionine sulfoxide, or O-methyl-L-homoserine
HXQGTFTSDYSXYLDXXXAXDFVQWLXNTKRNRNNIA

SEQ ID NO: 1907 - protein, 31 aa, Artificial Sequence
  OXM analog
  VARIANT (2)..(2): Xaa = D-Ser,  Aib,  Acb, Acx,  Abu, D-Abu, Aminovaleric acid (Nva), Cpa, Prg, Alg, 2-Cha, D-tbg, Vg, Acp, or Acpe
  VARIANT (10)..(10): Xaa=Tyr or Lys
  VARIANT (12)..(12): Xaa=Ser or Lys
  VARIANT (16)..(16): Xaa=Ser or Glu
  VARIANT (17)..(17): Xaa=Arg or Glu
  VARIANT (18)..(18): Xaa=Arg or Ala
  VARIANT (20)..(20): Xaa=Gln or Lys
  VARIANT (27)..(27): Xaa=methionine, norleucine, methionine sulfoxide, or O-methyl-L-homoserine
  VARIANT (31)..(31): Xaa=optional, but when present is one or more gamma glutamic acid residues
HXQGTFTSDXSXYLDXXXAXDFVQWLXNTKX

SEQ ID NO: 1908 - protein, 31 aa, Artificial Sequence; identical to SEQ ID NO: 1907
  OXM analog
  MOD_RES (2)..(2): Xaa = D-Ser,  Aib,  Acb, Acx,  Abu, D-Abu, Aminovaleric acid (Nva), Cpa, Prg, Alg, 2-Cha, D-tbg, Vg, Acp, or Acpe
  MOD_RES (10)..(10): Xaa=Tyr or Lys
  MOD_RES (12)..(12): Xaa=Ser or Lys
  MOD_RES (16)..(16): Xaa=Ser or Lys
  MOD_RES (17)..(17): Xaa=Arg or Glu
  MOD_RES (18)..(18): Xaa=Arg or Ala
  MOD_RES (20)..(20): Xaa=Gln or Lys
  MOD_RES (27)..(27): Xaa=methionine, norleucine, methionine sulfoxide, or O-methyl-L-homoserine
  MOD_RES (31)..(31): optional, but when present one or more gamma glutamic acid residues

SEQ ID NO: 1909 - protein, 30 aa, Artificial Sequence
  OXM analog
HSQGTFTSDSSKYLDSRRAQDFVQWLMNTK

SEQ ID NO: 1910 - protein, 32 aa, Artificial Sequence
  OXM analog
  MOD_RES (2)..(2): Xaa=D-serine, Aib, Acb, Acx, Abu, D-Abu,  Aminovaleric acid (Nva), Cpa, Prg, Alg, 2-Cha, D-tbg, Vg, Acp, or Acpe
  MOD_RES (10)..(10): Xaa=Tyr or Lys
  MOD_RES (12)..(12): Xaa=Ser or Lys
  MOD_RES (16)..(16): Xaa=Ser, aib,  or Glu
  MOD_RES (17)..(17): Xaa=Arg or Glu
  MOD_RES (18)..(18): Xaa=Arg or Ala
  MOD_RES (20)..(20): Xaa=Glu or Lys
  MOD_RES (27)..(27): Xaa=Met, norleucine, methionine sulfoxide, or O-methyl-L-homoserine
  MOD_RES (31)..(31): Xaa=gamma-glutamic acid
  MOD_RES (32)..(32): Xaa=is optional but when present, it is gamma-glutamic acid
HXQGTFTSDXSXYLDXXXAXDFVQWLXNTKXX

SEQ ID NO: 1911 - protein, 31 aa, Artificial Sequence
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (16)..(16): Xaa=Aib
  MOD_RES (31)..(31): Xaa=gamma-glutamic acid
  MOD_RES (31)..(31): C-terminal amidation
HXQGTFTSDXSKYLDXRRAQDFVQWLMNTEX

SEQ ID NO: 1912 - protein, 31 aa, Artificial Sequence
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (16)..(16): Xaa=aib
  MOD_RES (30)..(30): Xaa=D-Lys
  MOD_RES (31)..(31): Xaa=gamma-glutamic acid
  MOD_RES (31)..(31): C-terminal amidation
HXQGTFTSDXSKYLDXRRAQDFVQWLMNTXX

SEQ ID NO: 1913 - protein, 31 aa, Artificial Sequence; identical to SEQ ID NO: 1895
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (31)..(31): Xaa=gamma-glutamic acid
  MOD_RES (31)..(31): C-terminal amidation

SEQ ID NO: 1914 - protein, 31 aa, Artificial Sequence; identical to SEQ ID NO: 1911
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (16)..(16): Xaa=aib
  MOD_RES (31)..(31): Xaa=gamma-D-glutamic acid

SEQ ID NO: 1915 - protein, 31 aa, Artificial Sequence; identical to SEQ ID NO: 1895
  OXM analog
  MOD_RES (2)..(2): Xaa=D-serine
  MOD_RES (10)..(10): Xaa=Lys(glutamic acid-glutamic acid-palmitoyl)
  MOD_RES (31)..(31): Xaa=gamma-glutamic acid
  MOD_RES (31)..(31): C-terminal amidation

SEQ ID NO: 1916 - protein, 31 aa, Artificial Sequence; identical to SEQ ID NO: 1895
  OXM analog
  MOD_RES (2)..(2): Xaa=D-serine
  MOD_RES (10)..(10): Xaa=Lys(Arg-Arg-palmitoyl)
  MOD_RES (31)..(31): Xaa=gamma-glutamic acid
  MOD_RES (31)..(31): C-terminal amidation

SEQ ID NO: 1917 - protein, 31 aa, Artificial Sequence; identical to SEQ ID NO: 1895
  OXM analog
  MOD_RES (2)..(2): Xaa=D-Serine
  MOD_RES (10)..(10): Xaa=Lys(homocysteic acid-homocysteic acid-palmitoyl)
  MOD_RES (31)..(31): Xaa=gamma-glutamic acid
  MOD_RES (31)..(31): C-terminal amidation

SEQ ID NO: 1918 - protein, 31 aa, Artificial Sequence; identical to SEQ ID NO: 1895
  OXM analog
  MOD_RES (2)..(2): Xaa=D-Serine
  MOD_RES (10)..(10): Xaa=Lys(D-glutamic acid-D-glutamic acid-palmitoyl)
  MOD_RES (31)..(31): Xaa=gamma-glutamic acid
  MOD_RES (31)..(31): C-terminal amidation

SEQ ID NO: 1919 - protein, 31 aa, Artificial Sequence
  OXM analog
  MOD_RES (2)..(2): Xaa=D-Serine
  MOD_RES (10)..(10): Xaa=Lys(gamma-glutamic acid-gamma-glutamic acid-myristoyl)
  MOD_RES (16)..(16): Xaa=aib
  MOD_RES (31)..(31): Xaa=gamma-glutamic acid
  MOD_RES (31)..(31): C-terminal amidation
HXQGTFTSDXSKYLDXRRAQDFVQWLMNTKX

SEQ ID NO: 1920 - protein, 31 aa, Artificial Sequence
  OXM analog
  MOD_RES (2)..(2): Xaa=D-Serine
  MOD_RES (10)..(10): Xaa=Lys(gamma-glutamic acid-gamma-glutamic acid-palmitoyl)
  MOD_RES (16)..(16): Xaa=aib
  MOD_RES (31)..(31): Xaa=gamma-glutamic acid
  MOD_RES (31)..(31): C-terminal amidation
HXQGTFTSDXSKYLDXRAAQDFVQWLMDTKX

SEQ ID NO: 1921 - protein, 31 aa, Artificial Sequence; identical to SEQ ID NO: 1919
  OXM analog
  MOD_RES (2)..(2): Xaa=D-Serine
  MOD_RES (10)..(10): Xaa=Lys(gamma-glutamic acid-gamma-glutamic acid-stearoyl)
  MOD_RES (16)..(16): Xaa=aib
  MOD_RES (31)..(31): Xaa=gamma-glutamic acid
  MOD_RES (31)..(31): C-terminal amidation

SEQ ID NO: 1922 - protein, 28 aa, Artificial Sequence
  Analog of the insulin B chain
  MISC_FEATURE (6)..(6): Xaa at position 6 is histidine, aspartic acid, or glutamic acid, homocysteic acid or cysteic acid
  misc_feature (9)..(9): Xaa can be any naturally occurring amino acid
  misc_feature (21)..(21): Xaa can be any naturally occurring amino acid
  MISC_FEATURE (27)..(27): Xaa at position 27 is lysine or aspartic acid
  MISC_FEATURE (28)..(28): Xaa at position 28 is proline, ornithine or arginine
GPEHLCGAXLVDALYLVCGDXGFYFNXX

The invention claimed is:

1. A method of enhancing localization of an insulin analog to the liver after administration to a patient, said method comprising administering to the patient said insulin analog in the form of a conjugate formed between said insulin analog and a glucagon analog, wherein said insulin analog is a single chain insulin analog having the general formula IB-LM-IA wherein IB comprises an insulin B chain consisting of the sequence GPEHLCGAX$_{30}$LVDALYLVCGDX$_{42}$GFYFNX$_{48}$X$_{49}$ (SEQ ID NO: 1922);

LM comprises the sequence SSSSRAPPPSLPSPSR-LPGPSDTPILPQK (SEQ ID NO: 51), SSSSKAP-PPSLPSPSRLPGPSDTPILPQR (SEQ ID NO: 52), GYGSSSRR (SEQ ID NO: 18) or GAGSSSRR (SEQ ID NO: 22); and IA comprises an insulin A chain consisting of the sequence GIVDECCX$_8$X$_9$SCDLX$_{14}$X$_{15}$LX$_{17}$ X$_{18}$X$_{19}$CX$_{21}$-R$_{13}$ (SEQ ID NO: 35), wherein X$_8$ is threonine or phenylalanine;
X$_9$ is arginine, ornithine or alanine;
X$_{14}$ and X$_{15}$ are both arginine;
X$_{17}$ is glutamic acid;
X$_{18}$ is methionine, asparagine or threonine;
X$_{19}$ is tyrosine, 4-methoxy-phenylalanine or 4-amino phenylalanine;
X$_{21}$ is alanine or asparagine;
X$_{30}$ is histidine, aspartic acid, homocysteic acid and cysteic acid or glutamic acid;
X$_{42}$ is alanine, ornithine or arginine;
X$_{48}$ is lysine or aspartic acid;
X$_{49}$ is proline, ornithine or arginine;
R$_{13}$ is COOH; and said glucagon analog comprises a peptide selected from the group consisting of
HSQGTFTSDYSKYLX$_{75}$X$_{76}$RRAX$_{70}$DFVX$_{74}$WL-MX$_{78}$X$_{79}$ (SEQ ID NO: 82),
HAEGTFTSDVSSYLEEQAAREFIAWLVRGRG (SEQ ID NO: 700),
HSQGTFTSDYSKYLDERRAQX$_{61}$FVQWLXNT (SEQ ID NO: 94),
HSQGTFTSDYSKYLDERRAQDFVQWLMNT (SEQ ID NO: 98),
H(Aib)QGTFTSDKSKYLD(Aib)RRAQDFVQWLMNT (SEQ ID NO: 635) and
HSQGTFTSDYSKYLDSRRAQDFVQWLMNT (SEQ ID NO: 701), wherein
X$_{75}$ is Asp, Glu, cysteic acid, homoglutamic acid or homocysteic acid;
X$_{76}$ is Ser, Glu, Gln, homoglutamic acid or homocysteic acid;
X$_{70}$ is Gln or Lys;
X$_{61}$ is Asp, Cys, Orn, homocysteine or acetyl phenylalanine;
X$_{74}$ is Gln or Glu;
X$_{78}$ is Asn, Asp or Lys; and
X79 is Thr or Gly;
wherein the C-terminal region of the glucagon related peptide is linked to the insulin peptide at the N-terminal alpha amine of the B chain.

2. The method of claim 1 wherein the insulin analog is a single chain insulin analog wherein the carboxy terminus of the B chain is linked to the amino terminus of the A chain via a peptide linker selected from the group consisting of GYGSSSRR (SEQ ID NO: 18) and GAGSSSRR (SEQ ID NO: 22).

3. The method of claim 2 wherein the single chain insulin analog comprises the amino acid sequence of SEQ ID NO: 145.

4. The method of claim 3 wherein said glucagon analog comprises a peptide selected from the group consisting of
HAEGTFTSDVSSYLEEQAAREFIAWLVRGRG (SEQ ID NO: 700),
HSQGTFTSDYSKYLDERRAQDFVQWLMNT (SEQ ID NO: 98), and
HSQGTFTSDYSKYLDSRRAQDFVQWLMNT (SEQ ID NO: 701).

5. The method of claim 4 wherein
said glucagon analog comprises the sequence of HSQGTFTSDYSKYLDERRAQDFVQWLMNT (SEQ ID NO: 98) or HSQGTFTSDYSKYLDSRRAQDFVQWLMNT (SEQ ID NO: 701).

6. The method of claim 1 wherein said conjugate comprises the sequence of SEQ ID NO: 138.

7. A method of enhancing the localization of an insulin analog to the liver of a patient, said method comprising administering to the patient said insulin analog in the form of a conjugate formed between said insulin analog and a glucagon analog, wherein said conjugate comprises the sequence of SEQ ID NO: 135 or SEQ ID NO: 138.

8. An improved method of treating diabetes, said method comprising the steps of administering to a patient an insulin agonist formulated to enhance localization to the liver of said patient, wherein said formulated insulin agonist comprises said insulin agonist having been conjugated to a glucagon analog, wherein said conjugate comprises said insulin analog wherein the insulin analog comprises an A chain and a B chain that are linked to one another via intermolecular disulfide bonds, wherein said A chain comprises a peptide selected from the group consisting of GIVEQCCTSICSLYQLENYCN (SEQ ID NO: 1) or GIVDECCX$_8$RSCDLYQLENX$_{19}$CN (SEQ ID NO: 44), and said B chain comprises the sequence of FVNQHLCGSHLVEALYLVCGE-RGFFYTPKT (SEQ ID NO: 2) or X$_{25}$LCGAX$_{30}$LVDALYLVCGDX$_{42}$GFX$_{45}$ (SEQ ID NO: 38), wherein X$_8$ is threonine, histidine or phenylalanine;
X$_{19}$ is tyrosine, 4-methoxy-phenylalanine or 4-amino phenylalanine;
X$_{25}$ is histidine or threonine;
X$_{30}$ is histidine, aspartic acid or glutamic acid;
X$_{42}$ is alanine, lysine, ornithine and arginine;
X$_{45}$ is tyrosine or phenylalanine; and said glucagon analog, wherein said glucagon analog comprises a peptide selected from the group consisting of
HSQGTFTSDYSKYLDERRAQX7iFVQWLXNT (SEQ ID NO: 94),
HSQGTFTSDYSKYLX$_{75}$X$_{76}$RRAX$_{70}$DFVX$_{74}$WL-MX$_{78}$X$_{79}$ (SEQ ID NO: 82)
HSQGTFTSDYSKYLDERRAQDFVQWLMNT (SEQ ID NO: 98),
H(Aib)QGTFTSDKSKYLD(Aib)RRAQDFVQWLMNT (SEQ ID NO: 635) and
HSQGTFTSDYSKYLDSRRAQDFVQWLMNT (SEQ ID NO: 701), wherein
X$_{75}$ is Asp, Glu, cysteic acid, homoglutamic acid or homocysteic acid;
X$_{76}$ is Ser, Glu, Gln, homoglutamic acid or homocysteic acid;
X$_{70}$ is Gln or Lys;
X$_{71}$ is Asp, Cys, Orn, homocysteine or acetyl phenylalanine;

$X_{74}$ is Gln or Glu;
$X_{77}$ is Met, Leu or Nle;
$X_{78}$ is Asn, Asp or Lys; and
$X_{79}$ is Thr or Gly;
  wherein the C-terminal region of the glucagon related peptide is linked to the insulin peptide at a position selected from
    i) the side chain of an amino acid at a position selected from A9, A14 or A15 of the A chain, or positions B1, B2, B10, B22, B28 or B29 of the B chain; or
    ii) the N-terminal alpha amine of the B chain.

9. The method of claim 8 wherein the insulin analog is a single chain insulin analog wherein the carboxy terminus of the B chain is linked to the amino terminus of the A chain via a peptide linker selected from the group consisting of SSSSRAPPPSLPSPSRLPGPSDTPILPQK (SEQ ID NO: 51), SSSSKAPPPSLPSPSRLPGPSDTPILPQR (SEQ ID NO: 52) and GAGSSSRR (SEQ ID NO: 22).

10. The method of claim 9 wherein the carboxy terminus of the glucagon analog is covalently linked to the amino terminus of said single chain insulin analog.

11. The method of claim 10 wherein said A chain comprises the sequence of GIVEQCCTSICSLYQLENYCN (SEQ ID NO: 1) or GIVDECCX$_8$RSCDLYQLENX$_{19}$CN (SEQ ID NO: 44), and said B chain comprises the sequence of FVNQHLCGSHLVEALYLVCGERGFFYTPKT (SEQ ID NO: 2) or GPEHLCGAX$_{30}$LVDAL-YLVCGDX$_{42}$GFTFNX$_{48}$X$_{49}$ (SEQ ID NO: 1922), wherein
$X_8$ is phenylalanine or histidine;
$X_{19}$ is tyrosine;
$X_{30}$ is histidine, aspartic acid or glutamic acid;
$X_{42}$ is alanine ornithine or arginine;
$X_{48}$ is lysine or aspartic acid; and
$X_{49}$ is proline, ornithine or arginine.

12. The method of claim 11 wherein the carboxy terminus of the B chain is linked to the amino terminus of the A chain via a peptide linker comprising the sequence of GAGSSSRR (SEQ ID NO: 22).

13. The method of claim 10 wherein
said glucagon analog comprises the sequence of SEQ ID NO: 701;
said insulin peptide comprises an A chain sequence of GIVEQCCTSICSLYQLENYCN (SEQ ID NO: 1) and a B chain sequence of FVNQHLCGSHLVEALYL-VCGERGFFYTPKT (SEQ ID NO: 2), and
the carboxy terminus of the B chain is linked to the amino terminus of the A chain via a peptide linker comprising the sequence of GAGSSSRR (SEQ ID NO: 22).

14. The method of claim 10 wherein the
said glucagon analog comprises the sequence of HSQGTFTSDYSKYLDERRAQDFVQWLMNT (SEQ ID NO: 98) or H(Aib)QGTFTSDKSKYLD(Aib)RRAQDFVQWLMNT (SEQ ID NO: 635);
said insulin peptide comprises an A chain sequence of GIVEQCCTSICSLYQLENYCN (SEQ ID NO: 1) and a B chain sequence of FVNQHLCGSHLVEALYL-VCGERGFFYTPKT (SEQ ID NO: 2), and the carboxy terminus of the B chain is linked to the amino terminus of the A chain via a peptide linker comprising the sequence of GAGSSSRR (SEQ ID NO: 22).

* * * * *